US 6,583,266 B1
Jun. 24, 2003

(12) United States Patent
Smith et al.

(10) Patent No.: US 6,583,266 B1
(45) Date of Patent: Jun. 24, 2003

(54) **NUCLEIC ACID AND AMINO ACID SEQUENCES RELATING TO *MYCOBACTERIUM TUBERCULOSIS* AND *LEPRAE* FOR DIAGNOSTICS AND THERAPEUTICS**

(75) Inventors: Douglas R. Smith, Gloucester, MA (US); Jen-i Mao, Lexington, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 08/311,731

(22) Filed: Sep. 16, 1994

Related U.S. Application Data

(63) Continuation-in-part of application No. 08/109,181, filed on Aug. 19, 1993, now abandoned, and a continuation-in-part of application No. 08/142,558, filed on Oct. 22, 1993, now abandoned.

(51) Int. Cl.[7] ............................................. C07K 14/195
(52) U.S. Cl. ...................................................... 530/350
(58) Field of Search ......................................... 530/350

(56) References Cited

PUBLICATIONS

Critical Synergy: The Biotechnology Industry and Intellectual Property Protection, Biotechnology Industry Organization, Washington, D.C., Oct. 17, 1994, pp. 100–107.*

Harrison's principles of Internal Medicine, 12th ed., McGraw Hill Inc., NY, chapter 125–127, p. 637–650.

* cited by examiner

*Primary Examiner*—James Martinell
(74) *Attorney, Agent, or Firm*—Burns, Doane, Swecker & Mathis, LLP

(57) ABSTRACT

Embodiments of the present invention feature nucleic acid and proteins derived from *Mycobacterium tuberculosis* and *leprae*. The proteins and nucleic acid of the present invention have applications in diagnostics and therapeutics.

1 Claim, No Drawings

NUCLEIC ACID AND AMINO ACID SEQUENCES RELATING TO *MYCOBACTERIUM TUBERCULOSIS* AND *LEPRAE* FOR DIAGNOSTICS AND THERAPEUTICS

This application is a continuation-in-part of U.S. Ser. No. 08/109,181 filed Aug. 19, 1993, now abandoned, and U.S. Ser. No. 08/142,558 filed Oct. 22, 1993, now abandoned, the disclosure of which is incorporated by reference herein.

FIELD OF THE INVENTION

The present invention relates to non-naturally occurring nucleic acid and peptides corresponding to nucleic acid and peptides of *Mycobacterium tuberculosis* and *Mycobacterium leprae*. The nucleic acid and peptides of the present invention have utility for diagnostics and therapeutics.

BACKGROUND OF THE INVENTION

*Mycobacterium tuberculosis* is the causative agent of tuberculosis. Tuberculosis is a chronic bacterial infection characterized by the formation of granulomas in infected tissues and by cell mediated hypersensitivity. The usual site of the disease is the lungs but other organs may be involved. In countries where human immuno-deficiency virus (HIV) infection is endemic, tuberculosis is a frequent cause of morbidity in AIDS patients. Tuberculosis has shown a resurgence in recent years worldwide. Mycobacteria contain an array of protein and polysaccharide antigens giving rise to a cell mediated hypersensitivity. The hypersensitivity is often used to diagnose tuberculosis and to monitor the disease pathogenesis. See: *Harrison's Principles of Internal Medicine*, Twelfth Edition, McGraw-Hill, Inc., (1991), pp. 637–645.

*Mycobacterium leprae* is the causative agent of Hanson's disease or leprosy. Leprosy is a chronic infection of superficial tissues, especially the skin and peripheral nerves. *Mycobacterium leprae* multiplies slowly, and has not been grown in tissue culture or artificial media. *Mycobacterium leprae* does not elicit strong immunological responses in infected individuals. However, a serodiagnostic test for the detection of antibody to *Mycobacterium leprae* antigen is used to aid in the diagnosis. See Harrison, supra, pp. 645–648.

Patient care, as well as the prevention and transmission of *Mycobacterium tuberculosis* and *leprae*, requires reliable diagnostic and prognostic tools to detect nucleic acid, antigens and antibodies relating to tuberculosis and leprosy.

A number of therapeutic agents are currently available for combatting *Mycobacterium tuberculosis* and *Mycobacterium leprae* infections in man. However, limitations to these therapies, particularly for *Mycobacterium tuberculosis* infection, demonstrate that new, more effective agents are needed. For example, agents such as isoniazid and rifampicin are currently in use for *Mycobacterium tuberculosis* infections, but strains which are resistant to one or the other or both of these agents are being reported with increasing frequency (eg., Chawla et al., 1992, Am. Rev. Respir. Dis. 146, 278–279). In addition, *Mycobacterium tuberculosis* bacilli treated by drug therapy frequently remain viable, but dormant as latent infections in macrophage phagolysosomes which may re-emerge as full-blown tuberculosis at a later date (eg., Dannenberg, in "The Mycobacteria: A Sourcebook", Kubica and Wayne, eds., Dekker, N.Y., pp. 721–760).

BRIEF DESCRIPTION OF THE INVENTION

This invention relates to diagnostics and therapeutics for *Mycobacterium tuberculosis, M. leprae* and other mycobacterial species including, but not limited to: *M. avium, M. bovis, M. chitae, M. fortuitum, M. gorodonae, M. intracellulare, M. kansaii, M. paratuberculosis, M. smegmatis, M. terrae*, and *M. ulcerans*. One embodiment of the present invention features, as an article of manufacture or as a composition, a non-naturally occurring nucleic acid having twenty or more nucleotides in a sequence corresponding to a sequence of *Mycobacterium tuberculosis* or *Mycobacterium leprae* nucleic acid. The non-naturally occurring nucleic acid of the present invention is exemplified by Seq. ID No. 1 with respect to *Mycobacterium tuberculosis* and by Seq. ID Nos. 23–26 and 120–140 with respect to *Mycobacterium leprae*. Preferably, the sequence has at least twenty, and more preferably at least thirty nucleotides in a sequence corresponding to *Mycobacterium tuberculosis* or *Mycobacterium leprae* nucleic acid. The sequence may correspond to the entire coding sequence for the gene or a part of the coding sequence. However, sequences larger than 1000 nucleotides in length are difficult to synthesize.

One embodiment of the present invention features a non-naturally occurring nucleic acid wherein the nucleic acid encodes a peptide of *Mycobacterium tuberculosis* or *M. leprae* or other mycobacterial species. The peptide has utility for diagnostics and therapeutics.

A further embodiment of the present invention comprises a non-naturally occurring nucleic acid wherein the nucleic acid is capable of binding messenger RNA of *Mycobacterium tuberculosis* or *M. leprae* or other mycobacterial species. Such non-naturally occurring nucleic acid is capable of acting as anti-sense nucleic acid to control the translation of messenger RNA of *Mycobacterium tuberculosis, M. leprae* or other mycobacterial species. The non-naturally occurring nucleic acid inhibits the translation of *Mycobacterium tuberculosis, M. leprae* or other mycobacterial gene products, which by way of example, relate to the synthesis of antibiotics and the constituents of the cell wall, intermediary metabolism, transport processes, nucleic acid biosynthesis and modification, and antibiotic resistance. One of ordinary skill in the art would readily be able to discern which proteins were involved in the above metabolic processes. The above listed processes, as well as the proteins involved in such processes, are well described in any cellular biology textbook such as Molecular Cell Biology, Darnell, J., Lodish, H., and Baltimore, D. Scientific American Books, N.Y. Such non-naturally occurring nucleic acids have utility in therapeutics and diagnostics. A further embodiment of the present invention features a non-naturally occurring nucleic acid which nucleic acid is capable of binding specifically to *Mycobacterium tuberculosis* or *leprae* nucleic acid. Such non-naturally occurring nucleic acid has utility as probes and as capture reagents.

One embodiment of the present invention features an expression system comprising an open reading frame of DNA corresponding to *Mycobacterium tuberculosis* or *leprae* DNA. The nucleic acid further comprises a control sequence compatible with an intended host. The expression system is useful for making peptides corresponding to *Mycobacterium tuberculosis* or *leprae* nucleic acid.

A further embodiment of the present invention features a cell transformed with the expression system to make *Mycobacterium tuberculosis* or *leprae* proteins and peptides.

Several non-naturally occurring nucleic acids of the present invention feature nucleic acid relating to products involved in cell wall biosynthesis of *Mycobacterium tuberculosis*. Such nucleic acids have sequences of twenty or more nucleotides which correspond to sequences of Seq. ID No. 1. One such nucleic acid has a sequence of twenty or more nucleotides which correspond to a sequence within nucleotides 28,325 to 31,285 of Seq. ID No. 1. Nucleotides 28,325 to 31,285 encode a gene for polyketide or fatty acid synthesis. The gene codes for an enzyme with acyl transferase, enoyl reductase and dehydratase domains. The putative amino acid sequence of the gene product is set forth in Seq. ID No. 2.

An enzyme, ketoacyl ACP synthase of *Mycobacterium tuberculosis*, is encoded by nucleotides 26750 to 28237 of Seq. ID No. 1. The putative amino acid sequence of the enzyme is set forth in Seq. ID No. 3.

Nucleic acid encoding a gene for the enzyme beta-keto reductase of *Mycobacterium tuberculosis* corresponds to nucleotides 24636 to 26753 of Seq. ID No. 1. The putative amino acid sequence is set forth in Seq. ID No. 4.

Nucleic acid encoding COA ligases correspond to nucleotides 22136 to 23371 or 23251 to 23994 of Seq. ID No. 1. The putative amino acid sequence is set forth in Seq. ID No. 5 and Seq. ID No. 118.

Nucleic acids encoding two UDP-sugar transferases of *Mycobacterium tuberculosis* corresponds to nucleotides 9489 to 10846 of Seq. ID No. 1 and 12604 to 13995 of Seq. ID No. 1. The putative amino acid sequence are set forth in Seq. ID Nos. 6 and 7.

Nucleic acid encoding a methyltransferase of *Mycobacterium tuberculosis* corresponds to nucleotides 20006 to 19347 of Seq. ID No. 1. The putative amino acid sequence is set forth in Seq. ID No. 8.

Nucleic acid encoding a KdtB protein of *Mycobacterium tuberculosis* corresponds to nucleotides 5790 to 6275 of Seq. ID No. 1. KdtB protein is an essential 12 kD protein associated with the synthesis of lipopolysaccharide. The putative amino acid sequence is set forth in Seq. ID No. 9.

A further non-naturally occurring nucleic acid of the present invention has a sequence of twenty nucleotides which correspond to proteins involved in intermediary metabolism. One non-naturally occurring nucleic acid corresponds to a pyruvate carboxylase of *Mycobacterium tuberculosis*. Pyruvate carboxylase is involved in gluconeogenesis. The enzyme catalyzes ATP-dependent carboxylation of pyruvate to oxaloacetate in the presence of cofactors biotin and zinc. The nucleotides 1565 to 4939 of Seq. ID No. 1 encode the enzyme pyruvate carboxylase. The putative amino acid sequence of the enzyme is set forth in Seq. ID No. 10.

One non-naturally occurring nucleic acid has a sequence of twenty or more nucleotides corresponding to a phosphoribosylglycinamide formyltransferase. Phosphoribosylglycinamide formyltransferase catalyzes the third step in de novo purine biosynthesis. The nucleotides encoding phosphoribosylglycinamide formyltransferase are 8061 to 7144 of Seq. ID No. 1. The putative amino acid sequence of the enzyme is set forth in Seq. ID No. 11.

A further non-naturally occurring nucleic acid of the present invention corresponds to gene products involved in transport processes. One non-naturally occurring nucleic acid encodes a structural gene for an anion pump protein of *Mycobacterium tuberculosis*. The nucleic acid has a sequence which corresponds to a sequence within nucleotides 9369 to 8149 of Seq. ID No. 1 which encode the pump. The putative amino acid sequence is set forth in Seq. ID No. 12.

A further non-naturally occurring nucleic acid has a sequence of twenty or more nucleotides which correspond to gene products involved in DNA biosynthesis and cell division. One non-naturally occurring nucleic acid of the present invention corresponds to a *Mycobacterium tuberculosis* cell division protein. A *Mycobacterium tuberculosis* cell division protein is encoded at nucleotide positions 5042 to 5704 of Seq. ID No. 1. The putative amino acid sequence is set forth in Seq. ID No. 13.

One embodiment of the present invention features a non-naturally occurring nucleic acid having a sequence of twenty or more nucleotides which correspond to gene products that are involved in antibiotic resistance. One non-naturally occurring nucleic acid of the present invention corresponds to a ribosomal RNA methylase. The nucleic acid has a sequence of twenty or more nucleotides which corresponds to a sequence within nucleotides 17223 to 17933 of Seq. ID No. 1 encoding for the enzyme. The putative amino acid sequence is set forth in Seq. ID No. 14.

A further non-naturally occurring nucleic acid has a sequence of twenty or more nucleotides which correspond to a sequence of *Mycobacterium tuberculosis* useful as a probe to identify *Mycobacterium tuberculosis* genes or homologous genes in other mycobacteria or other related bacterial species. Nucleic acid sequences that are specific to *Mycobacterium tuberculosis* genes correspond to nucleotides 15841 to 15203, nucleotides 15131 to 14306, nucleotides 20491 to 21489, nucleotides 911 to 1540, nucleotides 16223 to 17161, nucleotides 24020 to 24619, nucleotides 3 to 902, nucleotides 11313 to 11651, and nucleotides 11766 to 12503. The putative amino acid sequences are set forth in Seq. ID Nos. 15, 16, 17, 18, 19, 20, 21, 22, 118 and 119. These amino acid sequences may define proteins which are specific to *Mycobacterium tuberculosis*. Such proteins may give rise to antibodies which are specific to *Mycobacterium tuberculosis*.

The *Mycobacterium tuberculosis* peptides, the functions of such peptides, and the nucleotide positions associated with such peptides within Seq. ID No. 1 are summarized in Table I below.

TABLE I

| Gene | Position | Enzyme name or activity (SeqID No.) | Function |
|---|---|---|---|
| ermK | 17223–17933 | ribosomal RNA methylase (# 14) | :resistance |
| gltA | 9489–10846 | putative UDP-sugar transferase (# 6) | :synth:carbo |
| gltB | 12604–13995 | putative UDP-sugar transferase (# 7) | :synth:carbo |
| kdtB | 5790–6275 | 12 kDa; lipopolysaccharide biosynth (# 9) | :synth:lipid |
| ligA | 22136–23371 | CoA ligase subunit (# 5) | :synth:lipid |
| ligB | 23251–23994 | CoA ligase subunit (# 118) | :synth:lipid |
| mtrA | 20006–19347 | putative methyl transferase (# 8) | :synth |
| pksA | 28325–31285 | polyketide synthase; AT, ER, DH (# 2) | :synth:lipid |
| pksB | 26750–28237 | polyketide synthase; AS (# 3) | :synth:lipid |
| pksC | 24636–26753 | polyketide synthase; KR (# 4) | :synth:lipid |
| pur3 | 8061–7144 | phosphoribosylglycinamide formyltr..(# 11) | :synth:nt |
| pycA | 1565–4939 | pyruvate carboxylase (# 10) | :metab |
| ttbc2a | 9369–8149 | anion pump protein (# 12) | :transport |
| yhhF | 5042–5704 | cell division protein (# 13) | :cell division |
| utbc2a | 15841–15203 | *M. tuberculosis* gene sequence (# 15) | :M.tb-specific |
| utbc2b | 15131–14306 | *M. tuberculosis* gene sequence (# 16) | :M.tb-specific |
| utbc2c | 20491–21489 | *M. tuberculosis* gene sequence (# 17) | :M.tb-specific |

TABLE I-continued

| Gene | Position | Enzyme name or activity (SeqID No.) | Function |
|---|---|---|---|
| utbc2d | 911–1540 | *M. tuberculosis* gene sequence (# 18) | :M.tb-specific |
| utbc2e | 16223–17161 | *M. tuberculosis* gene sequence (# 19) | :M.tb-specific |
| utbc2f | 24020–24619 | *M. tuberculosis* gene sequence (# 20) | :M.tb-specific |
| utbc2g | 3–902 | *M. tuberculosis* gene sequence (# 21) | :M.tb-specific |
| utbc2h | 11313–11651 | *M. tuberculosis* gene sequence (# 22) | :M.tb-specific |
| utbc2i | 11766–12503 | *M. tuberculosis* gene sequence (# 119) | :M.tb-specific |

Tables I–XXVI contain information on the genes encoded by the cosmid sequences with the corresponding Seq. ID Nos. (see table headings). Tables I–XIX consist of four columns with the heading gene, position, enzyme name or activity with Seq. ID No., and function. Tables XX–XXVI consist of five columns with the heading gene, SeqID, position, enzyme or protein name, and function. Under the heading "gene", a specific name is provided where the gene is positively identified by homology to other organisms, or a letter followed by the cosmid number. The letter "d" represents dehydrogenase, "t" represents transport associated, "a" represents ATPase. Under the heading "SeqID", a specific sequence ID number is provided. Under the heading "position", a range of nucleotides with the first and last numbers corresponding to the start and stop positions are identified which correspond to the respective Seq. ID No. In tables I–V, the start positions correspond to probable translation initiation codons; in tables VI–XXVI, the start positions correspond to the beginning of the reading frame which includes the predictable in vivo start site but usually is some distance away. Under the heading "Enzyme name or activity", an exact name may be given, an activity (e.g., dehydrogenase), an indication of homology to other sequences in public databases, or the designation—*M. leprae* gene sequence, indicating a previously un-described gene. Under the heading "function", a number of functional categories, as described in the text are identified; for example, "metab" denotes intermediary metabolism. In some cases metabolism is more specifically broken down in the following manner; "synth" denotes biosynthesis, "catab" denotes breakdown. Further information is sometimes given on the compounds involved; "lipid" denotes lipid, "aa" denotes amino acid, "nt" denotes nucleotide, "carbo" denotes carbohydrate, "glyco" denotes glycolysis, "antibiotic" denotes antibiotics, "protein" denotes "protein", "tca" denotes tricarboxylic acid cycle, "wall" denotes cell wall, "cofact" denotes cofactor (an indication of the specific cofactor sometimes follows), "*M. tb*-specific" denotes an *M. tuberculosis* gene useful as a probe, "*M. leprae*-specific" denotes an *M. leprae* gene useful as a probe, "transport" denotes a gene involved in transport, cell division denotes a gene involved in "cell division", "resistance" denotes a gene implicated in antibiotic resistance, "repair" denotes a DNA repair gene, "cell div." denotes a gene involved in cell division, "antigen" denotes a gene that is known to be a mycobacterial antigen, or an antigen in another organism that may be useful for vaccine development, "redox" denotes involved in electron transport, "stress" denotes a gene that is involved in cellular stress responses, "regulatory" denotes regulatory gene, "translation" denotes a gene whose product is involved in ribosome function, and "recombination" denotes a gene involved in recombination.

Several non-naturally occurring nucleic acids of the present invention feature nucleic acid relating to products of *Mycobacterium Leprae*. One non-naturally occurring nucleic acid of the present invention has a sequence of twenty or more nucleotides which correspond to a sequence within Seq.

ID Nos. 23–26 and 120–140. The *Mycobacterium Leprae* peptides, the functions of such peptides, and nucleotide positions associated with such peptides within Seq. ID No. 23 are summarized in Table II below.

Table II

| Gene | Position | Enzyme name or activity (SeqID No.) | Function |
|---|---|---|---|
| ybaB | 32443–32093 | 12 kD protein (# 27) | :*M. leprae*-specific |
| dhaS | 23517–22465 | aspartate-semialdehyde dehydrog. (# 28) | :metab. |
| glpK | 14121–12658 | glycerol kinase (# 29) | :metab. |
| akaB | 24783–23520 | aspartokinase (# 30) | :metab. |
| recM | 32078–31470 | recM/recR (# 31) | :repair:cell div. |
| leu1 | 25583–27298 | 2-isopropylmalate synthase (# 32) | :metab. |
| pbpA | 3032–5494 | penicillin binding protein (# 33) | :resistance |
| arsA | 1060–1914 | anion-transporting ATPase (# 34) | :transport |
| u0577a | 38–1063 | *M. leprae* gene sequence (# 35) | :*M.leprae*-specific |
| u0577b | 1911–2204 | *M. leprae* gene sequence (# 37) | :*M.leprae*-specific |
| u0577c | 5513–6622 | *M. leprae* gene sequence (# 38) | :*M.leprae*-specific |
| u0577d | 7161–7474 | *M. leprae* gene sequence (# 39) | :*M.leprae*-specific |
| u0577e | 10765–11355 | *M. leprae* gene sequence (# 40) | :*M.leprae*-specific |
| u0577f | 11789–12388 | *M. leprae* gene sequence (# 41) | :*M.leprae*-specific |
| u0577g | 14034–14276 | *M. leprae* gene sequence (# 42) | :*M.leprae*-specific |
| u0577h | 14269–14880 | *M. leprae* gene sequence (# 43) | :*M.leprae*-specific |
| u0577i | 15548–15922 | *M. leprae* gene sequence (# 44) | :*M.leprae*-specific |
| u0577j | 28664–29812 | *M. leprae* gene sequence (# 45) | :*M.leprae*-specific |
| u0577k | 29805–30512 | *M. leprae* gene sequence (# 46) | :*M.leprae*-specific |
| u0577l | 33851–35230 | *M. leprae* gene sequence (# 47) | :*M.leprae*-specific |
| u0577m | 35227–36546 | *M. leprae* gene sequence (# 48) | :*M.leprae*-specific |
| u0577n | 18608–17988 | *M. leprae* gene sequence (# 49) | :*M.leprae*-specific |
| u0577o | 22453–21305 | *M. leprae* gene sequence (# 50) | :*M.leprae*-specific |
| u0577p | 33762–33325 | *M. leprae* gene sequence (# 51) | :*M.leprae*-specific |

Nucleotides 32443 to 32093 of Seq. ID No. 23 encode a hypothetical 12 kD protein in the DNAX-RECR intergenic region. The putative amino acid sequence is set forth in Seq. ID No. 27.

One non-naturally occurring nucleic acid of the present invention corresponds to a sequence encoding the enzyme aspartate-semialdehyde dehydrogenase. The enzyme, aspartate-semialdehyde dehydrogenase, is involved in intermediary metabolism and is encoded by nucleotides 23517 to 22465 of Seq. ID No. 23. The putative amino acid sequence is set forth in Seq. ID No. 28.

One non-naturally occurring nucleic acid of the present invention has a sequence which corresponds to a sequence encoding the enzyme glycerol kinase. The enzyme, glycerol kinase, is involved in intermediary metabolism. The nucleotides encoding glycerol kinase are 14121 to 12658 of Seq. ID No. 23. The putative amino acid sequence is set forth in Seq. ID No. 29.

One non-naturally occurring nucleic acid of the present invention has a sequence which corresponds to a sequence encoding the enzyme aspartate kinase. The enzyme, aspartate kinase, is involved in intermediary metabolism. The nucleotide sequence encoding aspartate kinase are 24783 to 23520 of Seq. ID No. 23. The putative amino acid sequence is set forth in Seq. ID No. 30.

One non-naturally occurring nucleic acid of the present invention has a sequence which corresponds to a sequence encoding the RecM protein. This protein is involved in DNA repair DNA replication and cell division. The nucleotides encoding RecM protein are 32078 to 31470 of Seq. ID No. 23. The putative amino acid sequence is set forth in Seq. ID No. 31.

One non-naturally occurring nucleic acid of the present invention has a sequence which corresponds a sequence encoding to 2-isopropyl malate synthase. The enzyme, 2-isopropyl malate synthase, is involved in intermediary metabolism. The nucleotides encoding 2-isopropyl malate synthase are 25583 to 27298 of Seq. ID No. 23. The putative amino acid sequence is set forth in Seq. ID No. 32.

One non-naturally occurring nucleic acid of the present invention has a sequence which corresponds to a sequence encoding a penicillin binding protein, involved in antibiotic resistance. The nucleotides encoding the penicillin binding protein are 3032 to 5494 of Seq. ID No. 23. The putative amino acid sequence is set forth in Seq. ID No. 33.

One non-naturally occurring nucleic acid of the present invention has a sequence which corresponds to a sequence encoding an anion-transporting ATPase involved in transport processes. The nucleotides encoding this transport protein are 1060 to 1914 of Seq. ID No. 23. The putative amino acid sequence is set forth in Seq. ID No. 34.

Non-naturally occurring nucleic acids having a sequence of twenty or more nucleotides which correspond to a sequence of *Mycobacterium leprae* are useful as probes to identify *Mycobacterium leprae* genes or homologous genes in other mycobacteria or other related bacterial species. Nucleic acid sequences that are specific to *Mycobacterium leprae* genes correspond to nucleotides 38 to 1063, nucleotides 1060 to 1917, nucleotides 1911 to 2204, nucleotides 5513 to 6622, nucleotides 7161 to 7474, nucleotides 10765 to 11355, nucleotides 11789 to 12388, nucleotides 14034 to 14276, nucleotides 14269 to 14880, nucleotides 15548 to 15922, nucleotides 28664 to 29812, nucleotides 29805 to 30512, nucleotides 33851 to 35230, nucleotides 35227 to 36546, nucleotides 18608 to 17988, nucleotides 22453 to 21305, nucleotides 33762 to 33325 of Seq. ID No. 23. The respective putative amino acid sequences are set forth in Seq. ID Nos. 35–51.

*Mycobacterium leprae* peptides, the function of such peptides, and the nucleotide positions associated with such peptide within Seq. ID No. 24 are summarized in Table III set forth below.

TABLE III

| Gene | Position | Enzyme name or activity (SeqID No.) | Function |
|---|---|---|---|
| f1912a | 16941–18311 | CoA ligase modifying enzyme (# 52) | :metab. |
| dhpS | 28531–29322 | dihydropteroate synthase (fol. acid) (# 53) | :metab. |
| 3mg1 | 30740–31315 | dna-3-methyladenine glycosidase (# 54) | :metab, :repair |
| glgC | 33059–34315 | glucose-1-P-adenylyltransferase (# 55) | :synth:carbo |
| u1912a | 693–2900 | 68 kD tpp-requiring protein (# 56) | :metab. |
| ag45 | 20486–21097 | 45 kD serine-rich antigen (# 57) | :antigen |
| dcuP | 7954–9044 | uroporphyrinogen decarboxylase (# 58) | :metab. |
| u1912b | 4637–5104 | *M. leprae* gene sequence (# 59) | :*M.leprae*-specific |
| u1912c | 25695–26399 | *M. leprae* gene sequence (# 60) | :*M.leprae*-specific |
| u1912d | 26195–26758 | *M. leprae* gene sequence (# 61) | :*M.leprae*-specific |
| u1912e | 27975–28217 | *M. leprae* gene sequence (# 62) | :*M.leprae*-specific |
| u1912f | 29399–30484 | *M. leprae* gene sequence (# 63) | :*M.leprae*-specific |
| u1912g | 30396–30740 | *M. leprae* gene sequence (# 64) | :*M.leprae*-specific |
| u1912h | 30737–31315 | *M. leprae* gene sequence (# 65) | :*M.leprae*-specific |
| u1912i | 31589–31756 | *M. leprae* gene sequence (# 66) | :*M.leprae*-specific |
| u1912j | 34389–35042 | *M. leprae* gene sequence (# 67) | :*M.leprae*-specific |
| u1912k | 6290–5001 | *M. leprae* gene sequence (# 68) | :*M.leprae*-specific |
| u1912l | 6882–6292 | *M. leprae* gene sequence (# 69) | :*M.leprae*-specific |
| u1912m | 9041–10396 | *M. leprae* gene sequence (# 70) | :*M.leprae*-specific |
| u1912n | 19930–18315 | *M. leprae* gene sequence (# 71) | :*M.leprae*-specific |
| u1912o | 23399–22446 | *M. leprae* gene sequence (# 72) | :*M.leprae*-specific |
| u1912p | 32508–32260 | *M. leprae* gene sequence (# 73) | :*M.leprae*-specific |
| u1912q | 10402–11097 | *M. leprae* gene sequence (# 74) | :*M.leprae*-specific |
| u1912r | 35946–35617 | *M. leprae* gene sequence (# 75) | :*M.leprae*-specific |
| u1912s | 12935–13234 | *M. leprae* gene sequence (# 76) | :*M.leprae*-specific |
| u1912t | 13486–13779 | *M. leprae* gene sequence (# 77) | :*M.leprae*-specific |
| u1912u | 21186–21488 | *M. leprae* gene sequence (# 78) | :*M.leprae*-specific |
| u1912v | 21540–21827 | *M. leprae* gene sequence (# 79) | :*M.leprae*-specific |
| u1912w | 22002–22355 | *M. leprae* gene sequence (# 80) | :*M.leprae*-specific |
| u1912x | 23315–24517 | *M. leprae* gene sequence (# 81) | :*M.leprae*-specific |

One non-naturally occurring nucleic acid of the present invention has a sequence which corresponds to a sequence encoding a CoA ligase modifying enzyme. The enzyme, CoA ligase, is involved in intermediary metabolism. The nucleotides encoding this CoA ligase are 16941 to 18311 of Seq. ID No. 24. The putative amino acid sequence is set forth in Seq. ID No. 52.

One non-naturally occurring nucleic acid of the present invention has a sequence which corresponds to a sequence encoding dihydropteroate synthase (DHPS). The enzyme, dihydropteroate synthase is involved in intermediary metabolism. The nucleotides encoding DHPS are 28531 to 29322 of Seq. ID No. 24. The putative amino acid sequence is set forth in Seq. ID No. 53.

One non-naturally occurring nucleic acid of the present invention has a sequence which corresponds to a sequence encoding DNA-3-methyladenine glycosidase I. The enzyme, DNA-3-methyladenine glycosidase I, is involved in intermediary metabolism. The nucleotides encoding this glycosidase are 30740 to 31315 of Seq. ID No. 24. The putative amino acid sequence is set forth in Seq. ID No. 54.

One non-naturally occurring nucleic acid of the present invention has a sequence which corresponds to a sequence encoding glucose-1-phosphate adenyltransferase. The enzyme, glucose-1-phosphate adenyltransferase, is involved in intermediary metabolism. The nucleotides encoding this enzyme are 33059 to 34315 of Seq. ID No. 24. The putative amino acid sequence is set forth in Seq. ID No. 55.

One non-naturally occurring nucleic acid of the present invention has a sequence which corresponds to a sequence encoding a 68 kD thiamine pyrophosphate-requiring protein. The 68 kD enzyme is involved in intermediary metabolism. The nucleotides encoding this protein are 693 to 2900 of Seq. ID No. 24. The putative amino acid sequence is set forth in Seq. ID No. 56.

One non-naturally occurring nucleic acid of the present invention has a sequence which corresponds to a sequence encoding a probable antigen identified in *Mycobacterium tuberculosis*. The nucleotides encoding this probable antigen are 20486 to 21097 of Seq. ID No. 24. The putative amino acid sequence is set forth in Seq. ID No. 57.

One non-naturally occurring nucleic acid of the present invention has a sequence which corresponds to a sequence encoding uroporphyrinogen decarboxylase. The enzyme, uroporphyrinogen decarboxylase, is involved in intermediary metabolism. The nucleotides encoding this enzyme are 7954 to 9044 of Seq. ID No. 24. The putative amino acid sequence is set forth in Seq. ID No. 58.

Non-naturally occurring nucleic acids having a sequence of twenty or more nucleotides which correspond to a sequence of *Mycobacterium leprae* are useful as a probe to identify *Mycobacterium leprae* genes or homologous genes in other mycobacteria or other related bacterial species. Nucleic acid sequences that are specific to *Mycobacterium leprae* genes include nucleotides at positions 4637 to 5104, nucleotides 25695 to 26399, nucleotides 26195 to 26758, nucleotides 27995 to 28217, nucleotides 29399 to 30484, nucleotides 30396 to 30740, nucleotides 30737 to 31315, nucleotides 31589 to 31756, nucleotides 34389 to 35042, nucleotides 6290 to 5001, nucleotides 6882 to 6292, nucleotides 9041 to 10396, nucleotides 19930 to 18315, nucleotides 23399 to 22446, nucleotides 32508 to 32260, nucleotides 10402 to 11097, nucleotides 35946 to 35617, nucleotides 12935 to 13234, nucleotides 13486 to 13779, nucleotides 21186 to 21488, nucleotides 21540 to 21827, nucleotides 22002 to 22355, and nucleotides 23315 to 24517 of Seq. ID No. 24. The putative amino acid sequences are set forth in Seq. ID Nos. 59–81.

*Mycobacterium leprae* peptides, the function of such peptides, the nucleotide positions associated with, such peptides within Seq. ID No. 25 are summarized in Table IV set forth below.

TABLE IV

| Gene | Position | Enzyme name or activity (SeqID No.) | Function |
| --- | --- | --- | --- |
| adhA | 3301–4332 | alcohol dehydrogenase (# 82) | :metab. |
| fbp | 26808–25829 | fibronectin binding prot./85-B Ag (# 83) | :antigen:stress |
| ahpC | 12402–11818 | alkyl hydroperoxide reductase C (# 84) | :antigen:redox |
| bfr | 15629–16105 | bacterioferritin (# 85) | :redox |
| adhT | 28957–28664 | alcohol dehydrogenase (# 86) | :metab. |
| cysT | 139–396 | sulfate permease (# 87) | :transport |
| cpx | 22311–22078 | cytochrome P450 hydroxylase (# 88) | :synth: antibiotic: |
| oxyR | 12485–13447 | inducible regulatory protein (# 89) | :metab. |
| gox | 9872–8631 | 2-hydroxy-acid oxidase (# 90) | :metab |
| u0038a | 24755–24309 | *M. leprae* gene sequence (# 92) | :*M.leprae*-specific |
| u0038b | 34108–33197 | *M. leprae* gene sequence (# 93) | :*M.leprae*-specific |
| u0038c | 717–859 | *M. leprae* gene sequence (# 94) | :*M.leprae*-specific |
| u0038d | 1047–1268 | *M. leprae* gene sequence (# 95) | :*M.leprae*-specific |
| u0038e | 1928–2791 | *M. leprae* gene sequence (# 96) | :*M.leprae*-specific |
| u0038f | 2951–3250 | *M. leprae* gene sequence (# 97) | :*M.leprae*-specific |
| u0038g | 10854–11063 | *M. leprae* gene sequence (# 98) | :*M.leprae*-specific |
| u0038h | 5683–4985 | *M. leprae* gene sequence (# 99) | :*M.leprae*-specific |
| u0038i | 10433–10176 | *M. leprae* gene sequence (# 100) | :*M.leprae*-specific |
| u0038j | 24266–23821 | *M. leprae* gene sequence (# 101) | :*M.leprae*-specific |

One non-naturally occurring nucleic acid of the present invention has a sequence which corresponds to a sequence encoding alcohol dehydrogenase (ADH). The enzyme, alcohol dehydrogenase, is involved in intermediary metabolism and detoxification. The nucleotides encoding ADH are 3301 to 4332 of Seq. ID No. 25. The putative amino acid sequence is set forth in Seq. ID No. 82.

One non-naturally occurring nucleic acid of the present invention has a sequence which corresponds to a sequence encoding the *Mycobacterium leprae* 85-B antigen (alpha antigen). The nucleotides associated with 85-B antigen are 26808 to 25829 of Seq. ID No. 25. The putative amino acid sequence is set forth in Seq. ID No. 83.

One non-naturally occurring nucleic acid of the present invention has a sequence which corresponds to a sequence encoding a major mycobacterial antigen and the enzyme alkyl hydroperoxide reductase (AHPC). The enzyme, mycobacterial antigen, is a detoxifying enzyme. The nucleotides encoding AHPC are 12402 to 11818 of Seq. ID No. 25. The putative amino acid sequence is set forth in Seq. ID No. 84.

One non-naturally occurring nucleic acid of the present invention has a sequence which corresponds to a sequence encoding bacterioferritin (BFR). Bacterioferritin is involved in iron detoxification and storage. The nucleotides encoding BFR are 15629 to 16105 of Seq. ID No. 25. The putative amino acid sequence is set forth in Seq. ID No. 85.

One non-naturally occurring nucleic acid of the present invention has a sequence which corresponds to a sequence encoding alcohol dehydrogenase-T (ADH-T). The enzyme, alcohol dehydrogenase-T, is involved in intermediary metabolism. The nucleotides encoding ADH-T are 28957 to 28664 of Seq. ID No. 25. The putative amino acid sequence is set forth in Seq. ID No. 86.

One non-naturally occurring nucleic acid of the present invention has a sequence which corresponds to a sequence encoding a molybdenum or sulfate transport protein. The nucleotides encoding this transport protein are located at positions 139 to 396 of Seq. ID No. 25. The putative amino acid sequence is set forth in Seq. ID No. 87.

One non-naturally occurring nucleic acid of the present invention has a sequence which corresponds to a sequence encoding a cytochrome P450-like hydroxylase. This enzyme is involved in detoxification processes or antibiotic synthesis. The nucleotides encoding this protein are 22311 to 22078 of Seq. ID No. 25. The putative amino acid sequence is set forth in Seq. ID No. 88.

One non-naturally occurring nucleic acid of the present invention has a sequence which corresponds to a sequence encoding a hydrogen peroxide inducible regulatory protein (OXYR). The nucleotides OXYR are 12485 to 13447 of Seq. ID No. 25. The putative amino acid sequence is set forth in Seq. ID No. 89.

One non-naturally occurring nucleic acid of the present invention has a sequence which corresponds to a sequence encoding an enzyme (S)-2-hydroxy-acid oxidase (GOX). The enzyme, GOX is involved in intermediary metabolism. The nucleotides encoding GOX are 9872 to 8631 of Seq. ID No. 25. The putative amino acid sequence is set forth in Seq. ID No. 290.

Non-naturally occurring nucleic acids having a sequence of twenty or more nucleotides which correspond to a sequence of *Mycobacterium leprae* are useful as probes to identify *Mycobacterium leprae* genes or homologous genes in other mycobacteria or other related bacterial species. Nucleic acid sequences that are specific to *Mycobacterium leprae* genes include nucleotides at positions 139 to 396, nucleotides 24755 to 24309, nucleotides 34108 to 33197, nucleotides 717 to 859, nucleotides 1047 to 1268, nucleotides 1928 to 2791, nucleotides 2951 to 3250, nucleotides 10854 to 11063, nucleotides 5683 to 4985, nucleotides 10433 to 10176, and nucleotides 24266 to 23821 of Seq. ID No. 25. The putative amino acid sequences are set forth in Seq. ID Nos. 91–101.

*Mycobacterium leprae* peptides, the function of such peptides and the sequences associated with such peptides within Seq. ID No. 26 are summarized in Table V set forth below.

TABLE V

| Gene | Position | Enzyme name or activity (SeqID No.) | Function |
| --- | --- | --- | --- |
| cspA | 27760–28176 | cold-shock protein (# 102) | :stress |
| erc | 20362–19211 | DNA helicase excision repair (# 103) | :DNA repair |
| fadA | 7672–8880 | fatty acid oxidase beta subunit (# 104) | :metab. |
| fadB | 8855–11029 | fatty acid oxidase alpha subunit (# 105) | :metab. |
| dciP | 4228–2522 | indolepyruvate decarboxylase (# 106) | :metab. |
| u1935a | 37098–36712 | putative Ca-binding protein (# 107) | :metab. |
| u1935b | 4745–5074 | *M. leprae* gene sequence (# 108) | :*M.leprae*-specific |
| u1935c | 35805–34525 | *M. leprae* gene sequence (# 109) | :*M.leprae*-specific |
| u1935d | 16602–17078 | *M. leprae* gene sequence (# 110) | :*M.leprae*-specific |
| u1935e | 36372–37181 | *M. leprae* gene sequence (# 111) | :*M.leprae*-specific |
| u1935f | 6871–6071 | *M. leprae* gene sequence (# 112) | :*M.leprae*-specific |
| u1935g | 20856–20293 | *M. leprae* gene sequence (# 113) | :*M.leprae*-specific |
| u1935h | 21696–20893 | *M. leprae* gene sequence (# 114) | :*M.leprae*-specific |
| u1935i | 22673–21702 | *M. leprae* gene sequence (# 115) | :*M.leprae*-specific |
| u1935j | 25445–24921 | *M. leprae* gene sequence (# 116) | :*M.leprae*-specific |
| u1935k | 34517–34029 | *M. leprae* gene sequence (# 117) | :*M.leprae*-specific |

One non-naturally occurring nucleic acid of the present invention has a sequence which corresponds to a sequence encoding a cold-shock protein (CSPA). The protein, CSPA, is involved in cellular regulation processes. The nucleotides encoding CSPA are 27760 to 28176 of Seq. ID No. 26. The putative amino acid sequence is set forth in Seq. ID No. 102.

One non-naturally occurring nucleic acid of the present invention has a sequence which corresponds to a sequence encoding a DNA helicase similar to a human DNA excision repair protein. The enzyme is involved in DNA synthesis and replication. The nucleotides encoding this helicase are 20362 to 19211 of Seq. ID No. 26. The putative amino acid sequence is set forth in Seq. ID No. 103.

One non-naturally occurring nucleic acid of the present invention has a sequence which corresponds to a sequence encoding the *M. leprae* fatty acid oxidation complex beta subunit beta-ketothiolase (FadA). The enzyme, FadA is involved in intermediary metabolism. The nucleotides FadA are 7672 to 8880 of Seq. ID No. 26. The putative amino acid sequence is set forth in Seq. ID No. 104.

One non-naturally occurring nucleic acid of the present invention has a sequence which corresponds to a sequence encoding the multifunctional fatty acid oxidation complex alpha subunit (FadB). The enzyme, FadB, is involved in intermediary metabolism. The nucleotides encoding FadB are 8855 to 11029 of Seq. ID No. 26. The putative amino acid sequence is set forth in Seq. ID No. 105.

One non-naturally occurring nucleic acid of the present invention has a sequence which corresponds to a sequence encoding the *M. leprae* enzyme indolepyruvate decarboxylase (DCIP). The enzyme, DCIP, is involved in intermediary metabolism. The nucleotides encoding DCIP are located at positions 4228 to 2522 of Seq. ID No. 26. The putative amino acid sequence is set forth in Seq. ID No. 106.

One non-naturally occurring nucleic acid of the present invention has a sequence which corresponds to a sequence encoding a putative calcium binding protein. The protein is involved in intermediary metabolism. The nucleotides encoding this protein are 37098 to 36712 of Seq. ID No. 26. The putative amino acid sequence is set forth in Seq. ID No. 107.

Non-naturally occurring nucleic acids having a sequence of twenty or more nucleotides which correspond to a sequence of *Mycobacterium leprae* are useful as probes to identify *Mycobacterium leprae* genes or homologous genes in other mycobacteria or other related bacterial species. Nucleic acid sequences that are specific to *Mycobacterium leprae* genes include nucleotides at positions 4745 to 5074, nucleotides 35805 to 34525, nucleotides 16602 to 17078, nucleotides 36372 to 37181, nucleotides 6871 to 6071, nucleotides 20856 to 20293, nucleotides 21696 to 20893, nucleotides 22673 to 21702, nucleotides 25445 to 24921, and nucleotides 34517 to 34029 of Seq. ID No. 26. The putative amino acid sequences are set forth in Seq. ID Nos. 108–117.

One embodiment of the present invention features a non-naturally occurring protein or peptide of *Mycobacterium tuberculosis*. The protein or peptide preferably corresponds to a sequence encoded by Seq. ID No. 1. Preferably the protein or peptide is an antigen, or is involved in antibiotic or cell wall synthesis, intermediary metabolism, transport processes, nucleic acid biosynthesis or modification, cell division or antibiotic/drug resistance. Proteins and peptides of *Mycobacterium tuberculosis* are exemplified by Seq. ID Nos. 2–22, 118 and 119.

A further embodiment features a non-naturally occurring protein or peptide of *Mycobacterium leprae*. The protein or peptide preferably corresponds to a sequence within Seq. ID Nos. 23–26 or 120–140. Preferably, the protein or peptide is an antigen, or a protein involved in antibiotic or cell wall synthesis, intermediary metabolism, transport processes, nucleic acid biosynthesis or modification, cell division or antibiotic/drug resistance. Proteins and peptides of *Mycobacterium leprae* are exemplified by Seq. ID Nos. 27–117 and 141–411.

*Mycobacterium leprae* peptides, the function of such peptides, and the nucleotide positions associated with such peptides within Seq. ID No. 120 are summarized in Table VI set forth below.

TABLE VI

| Gene | Position | Enzyme name | Function |
| --- | --- | --- | --- |
| drrA | 25472–26569 | daunorubicin resistance protein | :transport |
| drrB | 26533–27432 | transmembrane ATPase | :transport |
| drrC | 27423–28163 | probable membrane component | :transport |
| pksA | 35–1963 | polyketide synthase | :synth:lipid:antibiotic |
| pksB | 1501–4395 | polyketide synthase | :synth:lipid:antibiotic |
| pksC | 4396–8736 | polyketide synthase | :synth:lipid:antibiotic |
| pksD | 8971–15621 | polyketide synthase | :synth:lipid:antibiotic |
| pksE | 15573–21065 | polyketide synthase | :synth:lipid:antibiotic |
| pksF | 21088–25563 | polyketide synthase | :synth:lipid:antibiotic |
| u1518a | 28289–29578 | match to *M. bovis* MAS orf4 | :*M. leprae*-specific |
| u1518b | 32481–33395 | *M. leprae* gene sequence | :*M. leprae*-specific |
| u1518c | 30755–30982 | *M. leprae* gene sequence | :*M. leprae*-specific |

*Mycobacterium leprae* peptides, the function of such peptides, and the nucleotide positions associated with such peptide within Seq. ID No. 121 are summarized in Table VII set forth below.

TABLE VII

| Gene | Position | Enzyme name | Function |
| --- | --- | --- | --- |
| acd | 24367–25548 | acyl-coA dehydrogenase | :metab |
| bccA | 16077–14224 | biotin carboxyl carrier protein | :metab |
| d1308a | 7737–7183 | probable dehydrogenase | :metab |
| d1308b | 8117–7905 | aldehyde dehydrogenase | :metab |
| latB | 10602–10970 | lysine 6-amino transferase | :synth:aa |

TABLE VII-continued

| Gene | Position | Enzyme name | Function |
| --- | --- | --- | --- |
| latB | 11263–11829 | lysine 6-amino transferase | :synth:aa |
| pabB | 28229–27210 | probable antigen B precursor | :antigen |
| pccB | 20220–18535 | propionyl-coA carboxylase | :metab |
| pur6 | 23643–24284 | phosphoribosylamino-imidazole carbox.. | :catab:tca |
| purK | 22402–23769 | phosphoribosylamino-imidazole carbox . . . | :*M. leprae*-specific |
| rpsB | 13687–14100 | sigma factor B | :regulation |
| thtR | 17448–16555 | thiosulfate sulfotransferase | :metab |
| t1308a | 28904–28638 | transport protein | :transport |
| u1308a | 4339–4593 | *M. leprae* gene sequence | :*M. leprae*-specific |
| u1308b | 4822–5190 | *M. leprae* gene sequence | :*M. leprae*-specific |
| u1308c | 4385–4654 | *M. leprae* gene sequence | :*M. leprae*-specific |
| u1308d | 32525–33139 | *M. leprae* gene sequence | :*M. leprae*-specific |
| u1308e | 13080–13358 | *M. leprae* gene sequence | :*M. leprae*-specific |
| u1308f | 20175–20507 | *M. leprae* gene sequence | :*M. leprae*-specific |
| u1308g | 25497–25760 | *M. leprae* gene sequence | :*M. leprae*-specific |
| u1308h | 29565–30092 | *M. leprae* gene sequence | :*M. leprae*-specific |
| u1308i | 3819–3325 | *M. leprae* gene sequence | :*M. leprae*-specific |
| u1308j | 9309–9025 | *M. leprae* gene sequence | :*M. leprae*-specific |
| u1308k | 22368–21676 | *M. leprae* gene sequence | :*M. leprae*-specific |
| u1308l | 22368–21676 | *M. leprae* gene sequence | :*M. leprae*-specific |
| u1308m | 30058–29828 | *M. leprae* gene sequence | :*M. leprae*-specific |
| u1308n | 33166–32813 | *M. leprae* gene sequence | :*M. leprae*-specific |
| u1308o | 32734–32330 | *M. leprae* gene sequence | :*M. leprae*-specific |
| u1308p | 1121–2224 | *M. leprae* gene sequence | :*M. leprae*-specific |
| u1308q | 21071–21721 | *M. leprae* gene sequence | :*M. leprae*-specific |
| u1308r | 18512–17646 | match to 21.2 kDa protein (yhde_ecoli) | :*M. leprae*-specific |
| u1308s | 7193–6450 | *M. leprae* gene sequence | :*M. leprae*-specific |

*Mycobacterium leprae* peptides, the function of such peptides, and the nucleotide positions associated with such peptides within Seq. ID No. 122 are summarized in Table VIII set forth below.

TABLE VIII

| Gene | Position | Enzyme name or activity | Function |
| --- | --- | --- | --- |
| bioA | 39641–38292 | adenosylmethionine-8-amino-7-oxon . . . | :synth:cofac:biotin |
| bioB | 35815–34661 | biotin synthetase | :synth:cofac:biotin |
| bioD | 37191–36451 | dethiobiotin synthase | :synth:cofac:biotin |
| bioF | 38291–37128 | 8-amino-7-oxononanoate synthase | :synth:cofac:biotin |
| echa | 1673–771 | enoyl-CoA hydratase | :catab:lipid:betaox |
| ligA | 9978–10628 | coenzyme A ligase | :*M. leprae*-specific |
| m1170a | 23927–17547 | mycocerosic acid synthase | :synth:lipid |
| m1170b | 7464–7087 | polyketide synthase | :synth:lipid |
| m1170c | 5853–5548 | polyketide synthase | :synth:lipid |
| nadA | 31541–30432 | quinolinate synthase | :synth:cofac:nad |
| nadB | 30657–29158 | L-aspartate oxidase | :synth:cofac:nad |
| nadC | 28896–27994 | nicotinate-nucleotide pyrophosphorylase | :synth:cofac:nad |
| r1170a | 2601–2861 | resistance protein | :resistance |
| t1170a | 16050–13018 | transport protein | :transport |
| u1170a | 9168–8884 | Mycobacterium MCAS-associated gene | :*M. leprae*-specific |
| u1170b | 17493–16051 | weak match to surfactin synthase | :*M. leprae*-specific |
| u1170c | 4045–3581 | weak match to chalcone synthases | :*M. leprae*-specific |
| u1170d | 8875–10011 | MCAS-associated protein | :*M. leprae*-specific |
| U1170e | 40416–41171 | p60 homolog of listeria invasion protein | :*M. leprae*-specific |
| u1170f | 4507–4767 | *M. leprae* gene sequence | :*M. leprae*-specific |
| U1170g | 31411–32289 | *M. leprae* gene sequence | :*M. leprae*-specific |
| U1170h | 33070–33471 | *M. leprae* gene sequence | :*M. leprae*-specific |

TABLE VIII-continued

| Gene | Position | Enzyme name or activity | Function |
|---|---|---|---|
| u1170i | 39532–39804 | *M. leprae* gene sequence | :*M. leprae*-specific |
| u1170j | 2093–2725 | *M. leprae* gene sequence | :*M. leprae*-specific |
| u1170k | 10598–11350 | *M. leprae* gene sequence | :*M. leprae*-specific |
| u1170l | 2916–3173 | *M. leprae* gene sequence | :*M. leprae*-specific |
| u1170m | 11403–12590 | *M. leprae* gene sequence | :*M. leprae*-specific |
| u1170n | 29546–28851 | *M. leprae* gene sequence | :*M. leprae*-specific |
| u1170o | 34561–33800 | *M. leprae* gene sequence | :*M. leprae*-specific |
| u1170p | 36171–35953 | *M. leprae* gene sequence | :*M. leprae*-specific |

*Mycobacterium leprae* peptides, the function of such peptides, and the nucleotide positions associated with such peptides within Seq. ID No. 123 are summarized in Table IX set forth below.

TABLE IX

| Gene | Position | Enzyme name or activity | Function |
|---|---|---|---|
| adaB | 30510–31031 | adenosine deaminase | :repair:metab |
| ars | 7367–6513 | arylsulfatase | :catab |
| c1549a | 13733–13236 | k⁺channel protein | :transport |
| cysM | 9487–9263 | cysteine synthase B | :synth:aa |
| glbA | 20087–20614 | 1,4-alpha-glucan branching enzyme | :synth:carbo |
| glbB | 21425–21721 | 1,4-alpha-glucan branching enzyme | :synth:carbo |
| glbC | 21722–22156 | 1,4-alpha-glucan branching enzyme | :synth:carbo |
| glbD | 20676–20894 | 1,4-alpha-glucan branching enzyme | :synth:carbo |
| glbE | 21039–21509 | 1,4-alpha-glucan branching enzyme | :synth:carbo |
| glr | 8234–7368 | glutamate racemase | :synth:aa |
| rnpH | 6432–5644 | ribonuclease PH | :translation:tRNA |
| rrnF | 5S rRNA | ribosomal RNA | :translation:rRNA |
| rrnL | 35S rRNA | ribosomal RNA | :translation:rRNA |
| rrnS | 16S rRNA | ribosomal RNA | :translation:rRNA |

TABLE IX-continued

| Gene | Position | Enzyme name or activity | Function |
|---|---|---|---|
| rx1549a | 2253–2029 | acetoacetyl-CoA reductase | :redox |
| t1549a | 19490–19170 | acetyltransferase | :synth |
| thi1 | 23184–22417 | thioredoxin | :redox |
| thiL | 24489–23299 | acetyl-coa acetyltransferase | :synth:PHB |
| u1549a | 11993–10752 | nylonase-like | :*M. leprae*-specific |
| u1549b | 5852–4947 | *M. leprae* gene sequence | :*M. leprae*-specific |
| u1549c | 17362–16871 | *M. leprae* gene sequence | :*M. leprae*-specific |
| u1549d | 15871–15551 | *M. leprae* gene sequence | :*M. leprae*-specific |
| u1549e | 9262–8945 | *M. leprae* gene sequence | :*M. leprae*-specific |
| u1549f | 8944–8183 | *M. leprae* gene sequence | :*M. leprae*-specific |
| u1549g | 12574–11840 | *M. leprae* gene sequence | :*M. leprae*-specific |
| u1549h | 1756–1974 | *M. leprae* gene sequence | :*M. leprae*-specific |
| u1549i | 32119–32415 | *M. leprae* gene sequence | :*M. leprae*-specific |
| u1549j | 4535–4906 | *M. leprae* gene sequence | :*M. leprae*-specific |
| u1549k | 24494–25039 | *M. leprae* gene sequence | :*M. leprae*-specific |
| u1549l | 35735–36052 | *M. leprae* gene sequence | :*M. leprae*-specific |
| u1549m | 36071–36361 | *M. leprae* gene sequence | :*M. leprae*-specific |
| u1549n | 4155–4550 | *M. leprae* gene sequence | :*M. leprae*-specific |
| u1549o | 19122–19421 | *M. leprae* gene sequence | :*M. leprae*-specific |
| u1549p | 27441–27722 | *M. leprae* gene sequence | :*M. leprae*-specific |
| u1549q | 30279–30494 | *M. leprae* gene sequence | :*M. leprae*-specific |
| u1549r | 32346–32780 | *M. leprae* gene sequence | :*M. leprae*-specific |
| u1549s | 28692–28183 | *M. leprae* gene sequence | :*M. leprae*-specific |
| u1549t | 15489–15094 | *M. leprae* gene sequence | :*M. leprae*-specific |
| u1549u | 1515–1138 | *M. leprae* gene sequence | :*M. leprae*-specific |
| u1549v | 18653–18051 | *M. leprae* gene sequence | :*M. leprae*-specific |
| u1549w | 16790–16266 | *M. leprae* gene sequence | :*M. leprae*-specific |
| u1549x | 12866–12453 | *M. leprae* gene sequence | :*M. leprae*-specific |
| u1549y | 29230–28556 | *M. leprae* gene sequence | :*M. leprae*-specific |
| u1549z | 26107–25427 | *M. leprae* gene sequence | :*M. leprae*-specific |

*Mycobacterium leprae* peptides, the function of such peptides, and the nucleotide positions associated with such peptides within Seq. ID No. 124 are summarized in Table X set forth below.

TABLE X

| Gene | Position | Enzyme name | Function |
|---|---|---|---|
| d2235a | 977–1282 | dehydrogenase | :metab |
| d2335b | 1500–1901 | dehydrogenase | :metab |
| dapF | 19144–18239 | diaminopimelate epimerase | :synth:aa |
| hflX | 18329–16710 | hflx protein *E. coli* | :*M. leprae*-specific |
| lexA | 7697–8425 | lexA | :regulatory:repair |
| miaA | 20197–19196 | tRNA:isopentenyltransferase | :translation |
| pgsA | 35747–35088 | cdp-diacylglycerol-glycerol-3-phosp | :synth:lipid |
| recA | 30502–28253 | recA | :recombination |
| thyA | 5415–5711 | thymidylate synthase | :synth:nt |
| tra9 | 14824–15039 | transposase | :transposon |
| u2235a | 6806–6318 | match to ybaD_Ecoli | :*M. leprae*-specific |
| u2235b | 28290–27772 | recA-related ORF | :*M. leprae*-specific |
| u2235c | 31946–30756 | crtX UDP-glucuronosyl-transferase | :*M. leprae*-specific |
| u2235d | 7489–6944 | *M. leprae* gene sequence | :*M. leprae*-specific |
| u2235e | 20835–20128 | *M. leprae* gene sequence | :*M. leprae*-specific |
| u2235f | 26340–25534 | *M. leprae* gene sequence | :*M. leprae*-specific |
| u2235g | 27755–26160 | *M. leprae* gene sequence | :*M. leprae*-specific |
| u2235h | 33858–33313 | *M. leprae* gene sequence | :*M. leprae*-specific |
| u2235i | 10587–8464 | Corynebacterium *M. leprae*-specific | :*M. leprae*-specific |

TABLE X-continued

| Gene | Position | Enzyme name | Function |
|---|---|---|---|
| u2235j | 2896–3927 | *M. leprae* gene sequence | :*M. leprae*-specific |
| u2235k | 34556–34050 | *M. leprae* gene sequence | :*M. leprae*-specific |
| u2235l | 34222–33722 | *M. leprae* gene sequence | :*M. leprae*-specific |
| u2235m | 35718–36032 | *M. leprae* gene sequence | :*M. leprae*-specific |
| u2235n | 3937–4191 | weak match to haloacetate dehalogenase | :*M. leprae*-specific |
| u2235o | 5125–5343 | *M. leprae* gene sequence | :*M. leprae*-specific |
| u2235p | 11383–11604 | *M. leprae* gene sequence | :*M. leprae*-specific |
| u2235q | 24715–25299 | *M. leprae* gene sequence | :*M. leprae*-specific |
| u2235r | 32479–32832 | *M. leprae* gene sequence | :*M. leprae*-specific |
| u2335s | 1283–1714 | *M. leprae* gene sequence | :*M. leprae*-specific |
| u2235t | 4970–5296 | *M. leprae* gene sequence | :*M. leprae*-specific |
| u2235u | 12323–12664 | *M. leprae* gene sequence | :*M. leprae*-specific |
| u2235v | 22556–22801 | *M. leprae* gene sequence | :*M. leprae*-specific |
| u2235w | 21376–21143 | *M. leprae* gene sequence | :*M. leprae*-specific |
| u2235x | 30885–32420 | *M. leprae* gene sequence | :*M. leprae*-specific |
| u2235y | 33312–33082 | *M. leprae* gene sequence | :*M. leprae*-specific |
| u2235z | 16431–16171 | *M. leprae* gene sequence | :*M. leprae*-specific |
| u2235aa | 15771–15535 | *M. leprae* gene sequence | :*M. leprae*-specific |
| u2235bb | 2583–2272 | *M. leprae* gene sequence | :*M. leprae*-specific |
| u2235cc | 16091–15858 | *M. leprae* gene sequence | :*M. leprae*-specific |
| u2335dd | 15177–15389 | *M. leprae* gene sequence | :*M. leprae*-specific |
| u2235ee | 30751–30539 | *M. leprae* gene sequence | :*M. leprae*-specific |

*Mycobacterium leprae* peptides, the function of such peptides, and the nucleotide positions associated with such peptides within Seq. ID No. 125 are summarized in Table XI set forth below.

TABLE XI

| Gene | Position | Enzyme name or activity | Function |
|---|---|---|---|
| apt | 9663–9400 | adenine phosphoribosyl-transferase | :DNA |
| apt2 | 9538–9005 | adenine phosphoribosyl-transferase | :nt |
| cypH | 5736–6650 | proline cis-trans isomerase-like | :*M. leprae*-specific |
| ligA | 16651–19251 | long-chain fatty acid-CoA ligase | :lipid:metab |
| gabT | 15206–16630 | aminotransferase | :*M. leprae*-specific |
| pol1 | 19055–20293 | polyketide synthase [Anabaena sp.] | :synth:lipid |
| ruvA | 22895–22275 | DNA repair protein | :repair |
| ruvB | 22408–21230 | DNA repair protein | :repair |
| ruvC | 23488–22883 | DNA repair protein | :repair |

TABLE XI-continued

| Gene | Position | Enzyme name or activity | Function |
|---|---|---|---|
| secD | 14403–12196 | protein secretion | :transport |
| secF | 12706–11429 | protein secretion | :transport |
| spoT | 9168–6709 | guanosine 3' 5' bis (diphosphate) 3' . . . | :synth:nt |
| syH | 4942–3656 | histidinyl-tRNA synthetase | :synth:protein |
| yebC | 28331–27555 | yebC Ecoli homolog | :*M. leprae*-specific |
| u1177a | 23715–23464 | *M. leprae* gene sequence | :*M. leprae*-specific |
| u1177b | 10824–9718 | dciAE gene product Bsubtilus | :*M. leprae*-specific |
| u1177c | 37821–38612 | ycb9_ Psede/ycfA_ Ecoli homolog | :*M. leprae*-specific |
| u1177f | 25360–25803 | *M. leprae* gene sequence | :*M. leprae*-specific |

TABLE XI-continued

| Gene | Position | Enzyme name or activity | Function |
|---|---|---|---|
| u1177g | 7681–8391 | Ecoli 77.2 Kd protein homolog | :M. leprae-specific |
| u1177h | 36689–36009 | weak match to gramicidin synth | :M. leprae-specific |
| u1177i | 26410–26790 | M. leprae gene sequence | :M. leprae-specific |
| u1177j | 26923–27207 | M. leprae gene sequence | :M. leprae-specific |
| u1177k | 33331–33618 | M. leprae gene sequence | :M. leprae-specific |
| u1177l | 35257–35559 | M. leprae gene sequence | :M. leprae-specific |
| u1177m | 20321–20662 | M. leprae gene sequence | :M. leprae-specific |
| u1177n | 28658–28897 | M. leprae gene sequence | :M. leprae-specific |
| u1177o | 24507–25343 | M. leprae gene sequence | :M. leprae-specific |
| u1177p | 32772–33068 | M. leprae gene sequence | :M. leprae-specific |
| u1177q | 39762–39442 | M. leprae gene sequence | :M. leprae-specific |
| u1177r | 31446–31000 | M. leprae gene sequence | :M. leprae-specific |
| u1177s | 30642–30397 | M. leprae gene sequence | :M. leprae-specific |
| u1177t | 30989–30717 | M. leprae gene sequence | :M. leprae-specific |
| u1177u | 21368–21078 | M. leprae gene sequence | :M. leprae-specific |
| u1177v | 37342–37052 | M. leprae gene sequence | :M. leprae-specific |
| u1177w | 15028–14678 | M. leprae gene sequence | :M. leprae-specific |
| u1177x | 6268–5732 | M. leprae gene sequence | :M. leprae-specific |
| u1177y | 29259–28531 | S. coelicolor histidine biosynthesis | :synth:aa |
| u1177aa | 3393–3073 | ipiB1 gene product [Phytophthora sp] | :M. leprae-specific |
| u1177ab | 40088–39681 | dedA protein Ecoli | :M. leprae-specific |
| u1177ac | 11570–10143 | M. leprae gene sequence | :M. leprae-specific |
| u1177ad | 10447–10235 | M. leprae gene sequence | :M. leprae-specific |
| u1177ae | 5698–4943 | M. leprae gene sequence | :M. leprae-specific |

*Mycobacterium leprae* peptides, the function of such peptides, and the nucleotide positions associated with such peptides within Seq. ID No. 126 are summarized in Table XII set forth below.

TABLE XII

| Gene | Position | Enzyme name | Function |
|---|---|---|---|
| a2126a | 16422–14530 | ATPase | :*M. leprae*-specific |
| bacA | 38533–38192 | bacitracin resistance prot homology Ecoli | :resistance |
| cysQ | 35494–34562 | match to *E. coli* cycQ | :*M. leprae*-specific |
| his1 | 22371–21487 | ATP-phosphoribosyl transferase | :synth:aa |
| his2 | 22661–22353 | phosphoribosyl-amp cyclohydrolase | :synth:aa |
| lysP | 28847–29650 | lysine-specific permease Ecoli | :transport |
| metH | 25145–24129 | methionine synthase | :synth:aa |
| metH | 27780–25078 | methionine synthase | :synth:aa |

TABLE XII-continued

| Gene | Position | Enzyme name | Function |
|---|---|---|---|
| aroP | 29574–30434 | aromatic aa transport Ecoli | :transport |
| aroP | 30482–32080 | aromatic aa transport Ecoli | :transport |
| pimT | 18549–17647 | protein-beta-aspartate methylt-ase | :catab:prot |
| prcB | 8970–8047 | proteasome, beta subunit | :catab:prot |
| pyrD | 40218–41330 | dihydroorotate dehydrogenase | :synth:nt |
| syC | 34469–33606 | cys tRNA synthetase | :translation |
| u2126a | 1095–133 | match to yigU and yigV *E. coli* | :*M. leprae*-specific |
| u2126b | 1470–1132 | match to yigT *E. coli* | :*M. leprae*-specific |
| u2126c | 13279–13665 | *M. leprae* gene sequence | :*M. leprae*-specific |
| u2126d | 14335–14763 | *M. leprae* gene sequence | :*M. leprae*-specific |
| u2126e | 22993–23226 | *M. leprae* gene sequence | :*M. leprae*-specific |
| u2126f | 27793–28779 | *M. leprae* gene sequence | :*M. leprae*-specific |
| u2126g | 40207–40503 | *M. leprae* gene sequence | :*M. leprae*-specific |
| u2126h | 21422–21694 | *M. leprae* gene sequence | :*M. leprae*-specific |
| u2126i | 39908–40240 | *M. leprae* gene sequence | :*M. leprae*-specific |
| u2126j | 17189–17533 | Match to Bsu ORF | :*M. leprae*-specific |
| u2126k | 41405–41887 | *M. leprae* gene sequence | :*M. leprae*-specific |
| u2126l | 16641–17231 | *M. leprae* gene sequence | :*M. leprae*-specific |
| u2126m | 20814–21263 | *M. leprae* gene sequence | :*M. leprae*-specific |
| u2126n | 23049–23768 | *M. leprae* gene sequence | :*M. leprae*-specific |
| u2126o | 38937–39989 | *M. leprae* gene sequence | :*M. leprae*-specific |
| u2126p | 37821–36883 | *M. leprae* gene sequence | :*M. leprae*-specific |
| u2126q | 36390–35416 | *M. leprae* gene sequence | :*M. leprae*-specific |
| u2126r | 20103–19813 | *M. leprae* gene sequence | :*M. leprae*-specific |
| u2126s | 12489–11986 | *M. leprae* gene sequence | :*M. leprae*-specific |
| u2126t | 10764–9142 | *M. leprae* gene sequence | :*M. leprae*-specific |
| u2126u | 1776–1471 | *M. leprae* gene sequence | :*M. leprae*-specific |
| u2126v | 18554–19447 | mycobacteriophage L5 homology | :*M. leprae*-specific |
| u2126w | 38246–37632 | *M. leprae* gene sequence | :*M. leprae*-specific |
| u2126x | 7187–6822 | *M. leprae* gene sequence | :*M. leprae*-specific |
| u2126y | 5618–5373 | *M. leprae* gene sequence | :*M. leprae*-specific |
| u2126z | 4916–3861 | *M. leprae* gene sequence | :*M. leprae*-specific |
| u2126aa | 2522–1701 | *M. leprae* gene sequence | :*M. leprae*-specific |
| u2126ab | 36910–36215 | *M. leprae* gene sequence | :*M. leprae*-specific |
| u2126ac | 33577–33215 | *M. leprae* gene sequence | :*M. leprae*-specific |
| u2126ad | 19744–19427 | *M. leprae* gene sequence | :*M. leprae*-specific |
| u2126ae | 17800–17372 | *M. leprae* gene sequence | :*M. leprae*-specific |
| u2212af | 13921–13640 | *M. leprae* gene sequence | :*M. leprae*-specific |
| u2126ag | 13345–12950 | *M. leprae* gene sequence | :*M. leprae*-specific |

TABLE XII-continued

| Gene | Position | Enzyme name | Function |
|---|---|---|---|
| u2126ah | 8053–7253 | *M. leprae* gene sequence | :*M. leprae*-specific |
| u2126ai | 6868–6569 | *M. leprae* gene sequence | :*M. leprae*-specific |
| u2126aj | 4114–3443 | *M. leprae* gene sequence | :*M. leprae*-specific |
| u2126ak | 3442–2441 | *M. leprae* gene sequence | :*M. leprae*-specific |
| u2126al | 23716–23928 | ham34 gene product [Bremia lactucae] | :*M. leprae*-specific |

*Mycobacterium leprae* peptides, the function of such peptides, and the nucleotide positions associated with such peptides within Seq. ID No. 127 are summarized in Table XIII set forth below.

TABLE XIII

| Gene | Position | Enzyme name or activity | Function |
|---|---|---|---|
| capP | 26821–24005 | phosphoenolpyruvate carboxylase | :catab:tca |
| coxX | 17264–16155 | cytochrome assembly factor | :redox |
| g3p | 32185–31115 | glyceraldehyde-3-phosphate deHase | :catab:carbo:glyco |
| g6pdA | 21301–21672 | glucose-6-phosphate dehydrogenase | :*M. leprae*-specific |
| g6pdB | 20997–21308 | glucose-6-phosphate dehydrogenase | :*M. leprae*-specific |
| g6pdC | 21633–21884 | glucose-6-phosphate dehydrogenase | :*M. leprae*-specific |
| nifS | 3821–2514 | homologue of nitrogen fixation gene | :*M. leprae*-specific |
| nifU | 2571–2020 | homologue of nitrogen fixation gene | :*M. leprae*-specific |
| pgk | 31145–29862 | phosphoglycerate kinase | :catab:carbo:glyco |
| t1496a | 4693–3773 | traffic ATPase | :transport |
| t1496b | 11040–11993 | drrA traffic ATPase | :transport |
| tkt | 17317–19419 | transketolase | :synth:carbo |
| tpiS | 29886–29080 | TPI (TIM) | :catab:carbo:glyco |
| u1496a | 15109–14645 | *M. leprae* gene sequence | :*M. leprae*-specific |
| u1496b | 718–275 | *M. leprae* gene sequence | :*M. leprae*-specific |
| u1496c | 9253–11049 | *M. leprae* gene sequence | :*M. leprae*-specific |
| u1496d | 15082–15306 | *M. leprae* gene sequence | :*M. leprae*-specific |
| u1496e | 15499–15978 | *M. leprae* gene sequence | :*M. leprae*-specific |
| u1496f | 19885–20562 | *M. leprae* gene sequence | :*M. leprae*-specific |
| u1496g | 22186–23022 | *M. leprae* gene sequence | :*M. leprae*-specific |
| u1496h | 23023–23781 | match to yeast ORF | :*M. leprae*-specific |
| u1496i | 962–1405 | *M. leprae* gene sequence | :*M. leprae*-specific |
| u1496j | 11762–12790 | *M. leprae* gene sequence | :*M. leprae*-specific |
| u1496k | 13397–14356 | *M. leprae* gene sequence | :*M. leprae*-specific |
| u1496l | 19085–19915 | transaldolase | :*M. leprae*-specific |
| u1496m | 32324–33412 | *M. leprae* gene sequence | :*M. leprae*-specific |
| u1496n | 28857–28507 | *M. leprae* gene sequence | :*M. leprae*-specific |
| u1496o | 27336–27085 | *M. leprae* gene sequence | :*M. leprae*-specific |
| u1496p | 24039–23698 | *M. leprae* gene sequence | :*M. leprae*-specific |
| u1496q | 5844–4552 | yca_yeast homolog | :*M. leprae*-specific |
| u1496r | 1728–1459 | fungus ORF homolog | :*M. leprae*-specific |
| u1496s | 29207–28821 | *M. leprae* gene sequence | :*M. leprae*-specific |
| u1496t | 28358–28131 | *M. leprae* gene sequence | :*M. leprae*-specific |
| u1496u | 22439–22086 | *M. leprae* gene sequence | :*M. leprae*-specific |
| u1496v | 21134–20700 | *M. leprae* gene sequence | :*M. leprae*-specific |
| u1496w | 9248–8388 | *M. leprae* gene sequence | :*M. leprae*-specific |
| u1496x | 8387–5727 | yca3_yeast homolog | :*M. leprae*-specific |
| u1496y | 2087–1698 | *M. leprae* gene sequence | :*M. leprae*-specific |
| u1496z | 27079–26840 | *M. leprae* gene sequence | :*M. leprae*-specific |

*Mycobacterium leprae* peptides, the function of such peptides, and the nucleotide positions associated with such peptides within Seq. ID No. 128 are summarized in Table XIV set forth below.

TABLE XIV

| Gene | Position | Enzyme name | Function |
|---|---|---|---|
| cfa | 22851–23921 | cyclopropane-fatty-acyl-phospholip Ecoli | :synth:lipid |
| cysG | 18016–16592 | uroporphyrin-iii c-methylt-ase | :synth:cofac:heme |
| gsa | 7593–6190 | glutamate-1-semialdehyde 2,1-aminot-ase | :*M. leprae*-specific |
| hem1 | 20446–18974 | glutamyl-trna reductase | :synth:cofac:heme |
| hem2 | 16297–15284 | delta-aminolevulinic acid deh2oase | :synth:cofac:heme |
| hem3 | 18490–18017 | porphobilinogen deaminase | :synth:cofac:heme |
| hem3 | 18969–18427 | porphobilinogen deaminase | :synth:cofac:heme |
| phoP | 36607–35969 | phosphate sensor | :regulatory |
| phoR | 37960–36608 | phosphate sensor | :regulatory |
| pmgY | 38851–38096 | phosphoglycerate mutase | :catab:carbo:glyco |
| ppx | 31790–30552 | exopolyphosphatase | :catab |
| proC | 27878–26970 | pyrroline-5-carboxylate reductase | :synth:aa |
| serB | 21424–22380 | phosphoserine phosphatase | :synth:aa |
| t2168a | 10404–10156 | permease | :transport |
| t2168b | 11030–10557 | permease | :transport |
| u2168a | 31534–32508 | *M. leprae* gene sequence | :*M. leprae*-specific |
| u2168b | 26163–25567 | match to rfbE | :*M. leprae*-specific |
| u2168c | 5624–4917 | weak match to thioredoxin | :*M. leprae*-specific |
| u2168d | 26844–26569 | weak match to excisionase | :*M. leprae*-specific |
| u2168e | 39445–38852 | *M. leprae* gene sequence | :*M. leprae*-specific |
| u2168f | 40823–39480 | match to rfaG or susY | :synth |
| u2168g | 42424–42741 | *M. leprae* gene sequence | :*M. leprae*-specific |
| u2168h | 4965–4132 | *M. leprae* gene sequence | :*M. leprae*-specific |
| u2168i | 8633–8926 | *M. leprae* gene sequence | :*M. leprae*-specific |
| u2168j | 22442–22984 | *M. leprae* gene sequence | :*M. leprae*-specific |
| u2168k | 33293–33805 | *M. leprae* gene sequence | :*M. leprae*-specific |
| u2168l | 34346–34630 | *M. leprae* gene sequence | :*M. leprae*-specific |
| u2168m | 34827–35060 | *M. leprae* gene sequence | :*M. leprae*-specific |
| u2168n | 35061–35300 | *M. leprae* gene sequence | :*M. leprae*-specific |
| u2168o | 35397–35762 | *M. leprae* gene sequence | :*M. leprae*-specific |
| u2168p | 25068–23950 | *M. leprae* gene sequence | :*M. leprae*-specific |
| u2168q | 15246–14935 | *M. leprae* gene sequence | :*M. leprae*-specific |
| u2168r | 13170–12910 | *M. leprae* gene sequence | :*M. leprae*-specific |
| u2168s | 12411–12139 | *M. leprae* gene sequence | :*M. leprae*-specific |
| u2168t | 12009–11608 | *M. leprae* gene sequence | :*M. leprae*-specific |
| u2168u | 3177–2509 | *M. leprae* gene sequence | :*M. leprae*-specific |
| u2168v | 591–247 | *M. leprae* gene sequence | :*M. leprae*-specific |
| u2168w | 33014–32673 | *M. leprae* gene sequence | :*M. leprae*-specific |
| u2168x | 30281–29487 | *M. leprae* gene sequence | :*M. leprae*-specific |
| u2168y | 29486–28614 | *M. leprae* gene sequence | :*M. leprae*-specific |

TABLE XIV-continued

| Gene | Position | Enzyme name | Function |
|---|---|---|---|
| u2168z | 25703–25059 | *M. leprae* gene sequence | :*M. leprae*-specific |
| u2168aa | 4145–2997 | *M. leprae* gene sequence | :*M. leprae*-specific |
| u2168ab | 6244–5582 | *M. leprae* gene sequence | :*M. leprae*-specific |
| u2168ac | 30576–30199 | *M. leprae* gene sequence | :*M. leprae*-specific |
| u2168ad | 26443–26225 | *M. leprae* gene sequence | :*M. leprae*-specific |
| u2168ae | 16682–16320 | *M. leprae* gene sequence | :*M. leprae*-specific |
| u2168af | 2557–1529 | *M. leprae* gene sequence | :*M. leprae*-specific |
| u2168ag | 11776–11420 | match to phospholipase | :catab |
| u2168ah | 41938–42423 | *M. leprae* gene sequence | :*M. leprae*-specific |

*Mycobacterium leprae* peptides, the function of such peptides, and the nucleotide positions associated with such peptides within Seq. ID No. 129 are summarized in Table XV set forth below.

TABLE XV

| Gene | Position | Enzyme name or activity | Function |
|---|---|---|---|
| abc1 | 40693–39500 | Yeast mt protein | :transport |
| cysA | 17806–18105 | sulfate permease | :transport |
| cysW | 17098–17553 | sulfate permease | :transport |
| dnaJ | 24656–25825 | heat shock | :stress |
| erA | 30210 31199 | GTPase? | :*M. leprae*-specific |
| lepA | 9501–11474 | lethal when overexpressed | :*M. leprae*-specific |
| phoH | 26887–27978 | phosphate metabolism | :metab |
| recQ | 37286–38086 | DNA helicase RECQ | :repair |
| subI | 15124–16245 | Sulfate-binding protein | :transport |
| uvrD | 35866–37278 | DNA helicase | :repair |
| ygrp | 23572–24180 | match to 38.8 kD protein (SP:P30727) | :*M. leprae*-specific |
| u1937a | 1195–1440 | *M. leprae* gene sequence | :*M. leprae*-specific |
| u1937b | 3361–5052 | match to 35.9 kDa protein (PIR:JQ1236) | :*M. leprae*-specific |
| u1937c | 27994–28545 | *M. leprae* gene sequence | :*M. leprae*-specific |
| u1937d | 28972–29418 | *M. leprae* gene sequence | :*M. leprae*-specific |
| u1937e | 32542–33534 | *M. leprae* gene sequence | :*M. leprae*-specific |
| u1937f | 1481–1723 | M. leprae gene sequence | :*M. leprae*-specific |
| u1937g | 1730–2935 | *M. leprae* gene sequence | :*M. leprae*-spedfic |
| u1937h | 5903–6868 | *M. leprae* gene sequence | :*M. leprae*-specific |
| u1937i | 6881–7465 | *M. leprae* gene sequence | :*M. leprae*-specific |
| u1937j | 8642–8857 | *M. leprae* gene sequence | :*M. leprae*-specific |
| u1937k | 33431–34417 | match to (gp:z26494) | :*M. leprae*-spedfic |
| u1937m | 14585–14881 | *M. leprae* gene sequence | :*M. leprae*-specific |
| u1937n | 16523–16933 | sulfate permease T protein | :*M. leprae*-specific |
| u1937o | 26192–26629 | *M. leprae* gene sequence | :*M. leprae*-specific |
| u1937p | 38468–38806 | *M. leprae* gene sequence | :*M. leprae*-specific |
| u1937q | 750–1076 | *M. leprae* gene sequence | :*M. leprae*-specific |

TABLE XV-continued

| Gene | Position | Enzyme name or activity | Function |
|---|---|---|---|
| u1937r | 4923–6029 | *M. leprae* gene sequence | :*M. leprae*-specific |
| u1937s | 19449–19667 | *M. leprae* gene sequence | :*M. leprae*-specific |
| u1937t | 20292–20852 | *M. leprae* gene sequence | :*M. leprae*-specific |
| u1937u | 24126–24617 | *M. leprae* gene sequence | :*M. leprae*-specific |
| u1937v | 25728–26255 | match to *S.coelicolor* gene | :*M. leprae*-specific |
| u1937w | 28677–29045 | *M. leprae* gene sequence | :*M. leprae*-specific |
| u1937x | 29835–30173 | *M. leprae* gene sequence | :*M. leprae*-specific |
| u1937y | 38112–38543 | *M. leprae* gene sequence | :*M. leprae*-specific |
| u1937z | 18537–18292 | *M. leprae* gene sequence | :*M. leprae*-specific |
| u1937aa | 8397–7645 | *M. leprae* gene sequence | :*M. leprae*-specific |
| u1937ab | 39581–38883 | *M. leprae* gene sequence | :*M. leprae*-specific |
| u1937ac | 21140–20898 | *M. leprae* gene sequence | :*M. leprae*-specific |
| u1937ad | 19160–18858 | *M. leprae* gene sequence | :*M. leprae*-specific |
| u1937ae | 18317–17802 | *M. leprae* gene sequence | :*M. leprae*-specific |
| u1937af | 11795–11532 | *M. leprae* gene sequence | :*M. leprae*-specific |
| u1937ag | 42766–41321 | *M. leprae* gene sequence | :*M. leprae*-specific |
| u1937ah | 38932–38603 | *M. leprae* gene sequence | :*M. leprae*-specific |
| u1937aj | 35383–35072 | *M. leprae* gene sequence | :*M. leprae*-specific |
| u1937ak | 13666–13298 | *M. leprae* gene sequence | :*M. leprae*-specific |
| u1937al | 3235–2972 | *M. leprae* gene sequence | :*M. leprae*-specific |

*Mycobacterium leprae* peptides, the function of such peptides, and the nucleotide positions associated with such peptides within Seq. ID No. 130 are summarized in Table XVI set forth below.

TABLE XVI

| Gene | Position | Enzyme name or activity | Function |
|---|---|---|---|
| acvS | 32477–32112 | cysteinyl synthetase | :synth:aa |
| alr | 9181–7928 | alanine racemase | :synth:wall |
| chA | 4066–3749 | 10 kd chaperonin | :antigen:stress |
| dceA | 10449–10117 | glutamate decarboxylase(DCEA) | :metab |
| dceB | 10104-9784 | glutamate decarboxylase(DCEA) | :metab |
| dceC | 9977–9624 | glutamate decarboxylase(DCEA) | :metab |
| glmS | 14311–12359 | glucosamine-fructose-5-phosphate | :*M. leprae*-specific |
| groE1 | 3679–2057 | groE1 protein-*m. leprae* | :antigen:stress |
| ilvi1 | 29556–28255 | acetolactate synthase | :synth:aa:iv:1 |
| ilvi2 | 29864–29337 | acetolactate synthase | :synth:aa:iv:1 |
| rim | 6561–5383 | ribosomal acetyltransferase | :translation |
| rl13 | 20260–19787 | large ribosomal subunit p13 | :translation |
| rs9 | 19886–19329 | small ribosomal subunit p9 | :translation |
| u0229a | 1054–1458 | Regulatory protein | :regulation |

TABLE XVI-continued

| Gene | Position | Enzyme name or activity | Function |
|---|---|---|---|
| u0229b | 14239–15270 | *M. leprae* gene sequence | :*M. leprae*-specific |
| u0229c | 24448–24750 | *M. leprae* gene sequence | :*M. leprae*-specific |
| u0229d | 26443–26712 | *M. leprae* gene sequence | :*M. leprae*-specific |
| u0229e | 35122–35457 | *M. leprae* gene sequence | :*M. leprae*-specific |
| u0229f | 13748–14269 | *M. leprae* gene sequence | :*M. leprae*-specific |
| u0229g | 15620–16030 | *M. leprae* gene sequence | :*M. leprae*-specific |
| u0229h | 9024–9443 | *M. leprae* gene sequence | :*M. leprae*-specific |
| u0229i | 25887–26549 | *M. leprae* gene sequence | :*M. leprae*-specific |
| u0229j | 27486–27274 | pyrophosphokinase | :*M. leprae*-specific |
| u0229k | 21717–21499 | *M. leprae* gene sequence | :*M. leprae*-specific |
| u0229l | 20796–20482 | *M. leprae* gene sequence | :*M. leprae*-specific |
| u0229m | 17346–17002 | *M. leprae* gene sequence | :*M. leprae*-specific |
| u0229n | 15735–15499 | *M. leprae* gene sequence | :*M. leprae*-specific |
| u0229o | 8088–6937 | *M. leprae* gene sequence | :*M. leprae*-specific |
| u0229p | 825–1 | *M. leprae* gene sequence | :*M. leprae*-specific |
| u0229q | 31751–31473 | *M. leprae* gene sequence | :*M. leprae*-specific |
| u0229r | 31118–30891 | *M. leprae* gene sequence | :*M. leprae*-specific |
| u0229s | 30179–29865 | *M. leprae* gene sequence | :*M. leprae*-specific |
| u0229t | 23951–23682 | *M. leprae* gene sequence | :*M. leprae*-specific |
| u0229u | 1076–810 | *M. leprae* gene sequence | :*M. leprae*-specific |
| u0229v | 24568–24311 | *M. leprae* gene sequence | :*M. leprae*-specific |
| u0229w | 23686–23450 | *M. leprae* gene sequence | :*M. leprae*-specific |
| u0229x | 22795–22484 | *M. leprae* gene sequence | :*M. leprae*-specific |
| u0229y | 12019–11570 | *M. leprae* gene sequence | :*M. leprae*-specific |
| u0229z | 18863–17832 | match to 47.5 kd *E. coli* protein | :*M. leprae*-specific |
| u0229aa | 19279–18701 | match to 47.5 kd *E. coli* protein | :*M. leprae*-specific |
| u0229ab | 5530–4514 | match to 36.0 kd *E. coli* ribosomal | :*M. leprae*-specific |
| u0229ac | 7058–6459 | match to 16.9 kd *E. coli* protein | :*M. leprae*-specific |
| u0229ad | 11891–10677 | match to *E. coli* amiB 5' regulatory | :*M. leprae*-specific |

*Mycobacterium leprae* peptides, the function of such peptides, and the nucleotide positions associated with such peptides within Seq. ID No. 131 are summarized in Table XVII set forth below.

TABLE XVII

| Gene | Position | Enzyme name or activity | Function |
|---|---|---|---|
| ag42 | 5160–3910 | 45 KDa antigen (gp:z21952 | :antigen |
| chA | 40918–40409 | 10 KDa chaperonin | :antigen:stress |
| choD | 30517–28730 | cholesterol oxidase | :catab:lipid |
| groE1 | 40339–38717 | groE1 | :antigen:stress |
| guaA | 23093–21258 | gmp synthase | :synth:nt |
| impA | 31856–30504 | inosine-5'-monophosphate dehydrog | :synth:nt |
| impB | 33271–31640 | inosine-5'-monophosphate dehydrog | :synth:nt |
| otsB | 616–1908 | trehalose-phosphatase | :*M. leprae*-specific |
| rbsB | 16757–17830 | ribose binding protein | :transport |
| rbsC | 18050–19951 | ribose transport protein | :transport |
| s1620a | 37713–38117 | sigma factor | :regulatory |
| s1620b | 36241–35942 | sigma factor | :regulatory |
| u1620a | 6328–6816 | transposase | :*M. leprae*-specific |
| u1620b | 7618–7286 | transposase | :*M. leprae*-specific |
| u1620c | 42190–40991 | match to glycoproteinase | :*M. leprae*-specific |
| u1620f | 25213–27627 | *M. leprae* gene sequence | :*M. leprae*-specific |
| u1620g | 20058–21176 | *M. leprae* gene sequence | :*M. leprae*-specific |
| u1620h | 10682–9489 | *M. leprae* gene sequence | :*M. leprae*-specific |
| u1620i | 7738–8049 | *M. leprae* gene sequence | :*M. leprae*-specific |
| u1620j | 2166–1690 | *M. leprae* gene sequence | :*M. leprae*-specific |
| u1620k | 5660–5262 | weak match 32 KD protein (sp:p16645) | :*M. leprae*-specific |
| u1620l | 9446–9111 | *M. leprae* gene sequence | :*M. leprae*-specific |
| u1620m | 2191–1979 | weak match 42.1 KD protein(sp:p29156) | :*M. leprae*-specific |
| u1620n | 2542–2282 | weak match to (gp:x66077) | :*M. leprae*-specific |
| u1620o | 9256–8447 | *M. leprae* gene sequence | :*M. leprae*-specific |
| u1620p | 13237–13515 | *M. leprae* gene sequence | :*M. leprae*-specific |
| u1620q | 13642–13956 | *M. leprae* gene sequence | :*M. leprae*-specific |
| u1620r | 12686–12976 | *M. leprae* gene sequence | :*M. leprae*-specific |
| u1620s | 12480–12836 | weak match to (gp:104527) | :*M. leprae*-specific |
| u1620t | 23445–23975 | weak match 44.7 KD protein(sp:p31049) | :*M. leprae*-specific |
| u1620u | 24399–25235 | *M. leprae* gene sequence | :*M. leprae*-specific |
| u1620v | 27945–27673 | *M. leprae* gene sequence | :*M. leprae*-specific |
| u1620w | 33375–33797 | *M. leprae* gene sequence | :*M. leprae*-specific |
| u1620x | 34396–34049 | *M. leprae* gene sequence | :*M. leprae*-specific |
| u1620y | 35014–34772 | *M. leprae* gene sequence | :*M. leprae*-specific |
| u1620z | 35428–35153 | *M. leprae* gene sequence | :*M. leprae*-specific |
| u1620aa | 35791–35549 | *M. leprae* gene sequence | :*M. leprae*-specific |
| u1620ab | 37444–36605 | *M. leprae* gene sequence | :*M. leprae*-specific |
| u1620ac | 37735–37469 | *M. leprae* gene sequence | :*M. leprae*-specific |

*Mycobacterium leprae* peptides, the function of such peptides, and the nucleotide positions associated with such peptides within Seq. ID No. 132 are summarized in Table XVIII set forth below.

TABLE XVIII

| Gene | Position | Enzyme name | Function |
|---|---|---|---|
| add | 16658–15639 | adenosine deaminase | :catab:nt |
| d0308a | 2859–2626 | dehydrogenase | :*M. leprae*-specific |
| d0308b | 2017–1757 | dehydrogenase | :*M. leprae*-specific |
| dhsA1 | 18908–19738 | succinate dehydrogenase | :catab:tca |
| dhsA2 | 17886–19190 | succinate dehydrogenase | :catab:tca |
| dhsB | 19618–20532 | succinate dehydrogenase | :catab:tca |
| glpD | 2478–703 | aerobic glycerol-3-phosphate deh-ase | :catab |
| idhpA | 34023–33808 | isocitrate dehydrogenase | :catab:tca |
| idhpB | 33644–33378 | isocitrate dehydrogenase | :catab:tca |
| idhpC | 34369–34142 | isocitrate dehydrogenase | :catab:tca |
| idhpB | 33976–33593 | isocitrate dehydrogenase | :catab:tca |
| idhpB | 33535–33218 | isocitrate dehydrogenase | :catab:tca |
| met2 | 36069–36410 | homoserine acetyltransferase | :synth:aa |
| met5a | 34828–35145 | homoserine sulfhydralase | synth:aa |
| met5b | 35410–36102 | homoserine sulfhydralase | :synth:aa |
| met5c | 35087–35434 | homoserine sulfhydralase | :synth:aa |
| pbpB | 25732–26523 | penicillin binding protein | :wall |
| pbpC | 25085–25837 | penicillin binding protein | :wall |
| pnpH | 7955–8950 | purine nucleoside phosphorylase | :catab:nt |
| syW | 32289–31243 | Trp tRNA synthetase | :translation |
| tpeA | 32298–33221 | match to tropinesterase | :*M. leprae*-specific |
| merA | 3987–3766 | match to merA protein | :*M. leprae*-specific |
| u0308a | 23625–23867 | probable acetyltransferase | :*M. leprae*-specific |
| u0308b | 8878–10563 | match to phosphomannomutase | :*M. leprae*-specific |
| u0308c | 7438–8073 | | :*M. leprae*-specific |
| u0308d | 12202–12771 | | :*M. leprae*-specific |
| u0308e | 12202–12771 | | :*M. leprae*-specific |
| u0308f | 29947–30240 | | :*M. leprae*-specific |
| u0308g | 12926–13525 | | :*M. leprae*-specific |
| u0308h | 16709–17476 | | :*M. leprae*-specific |
| u0308i | 22067–22306 | | :*M. leprae*-specific |
| u0308j | 23432–23689 | | :*M. leprae*-specific |
| u0308k | 27758–28018 | | :*M. leprae*-specific |
| u0308l | 28748–28978 | | :*M. leprae*-specific |
| u0308m | 4092–4625 | | :*M. leprae*-specific |
| u0308n | 12708–13025 | match to nusG protein | :*M. leprae*-specific |
| u0308o | 26865–27119 | possible glucose transporter | :*M. leprae*-specific |
| u0308p | 28953–28495 | | :*M. leprae*-specific |
| u0308q | 25818–25273 | | :*M. leprae*-specific |
| u0308r | 14874–14437 | | :*M. leprae*-specific |
| u0308s | 11262–10900 | match to uracil phosphoribosyl-transferase | :*M. leprae*-specific |
| u0308t | 5475–5038 | | :*M. leprae*-specific |
| u0308u | 35264–34986 | | :*M. leprae*-specific |
| u0308v | 23081–22758 | | :*M. leprae*-specific |
| u0308w | 22592–22317 | | :*M. leprae*-specific |
| u0308x | 18272–17928 | | :*M. leprae*-specific |
| u0308y | 11018–10704 | match to uracil phosphoribosyl-transferase | :*M. leprae*-specific |
| u0308z | 7823–7425 | | :*M. leprae*-specific |
| u0308aa | 31480–30290 | match to metallothioneins | :*M. leprae*-specific |
| u0308ab | 21010–20654 | | :*M. leprae*-specific |
| u0308ac | 6043–5720 | | :*M. leprae*-specific |

*Mycobacterium leprae* peptides, the function of such peptides, and the nucleotide positions associated with such peptides within Seq. ID No. 133 are summarized in Table XIX set forth below.

TABLE XIX

| Gene | Position | Enzyme name | Function |
|---|---|---|---|
| poIIA | 2289–643 | DNA Polymerase I-*M.tuberculosis* | :replication |
| poIIB | 3382–2273 | DNA Polymerase I | :replication |
| pyrG | 27752–25824 | CTP synthase | :synth:nt |
| recN | 31868–30105 | recombinase | :recombination |
| syy | 39193–38282 | Tyr tRNA-synthetase | :translation |
| u0247a | 33657–32824 | hemolysin | :*M. leprae*-specific |
| u0247b | 23927–22857 | *M. leprae*-specific family | :*M. leprae*-specific |
| u0247c | 8082–7870 | probable oxidase | :*M. leprae*-specific |
| u0247d | 25243–24260 | match to integrase | :*M. leprae*-specific |
| u0247e | 19935–18493 | *M. leprae* gene sequence | :*M. leprae*-specific |
| u0247f | 33076–31892 | utrl Sce *M. leprae* -specific | :*M. leprae*-specific |
| u0247g | 21289–20543 | *E. coli* rpsA region protein | :*M. leprae*-specific |
| u0247h | 3617–3390 | *M. lepraegene* sequence | :*M. leprae*-specific |
| u0247i | 8062–8460 | *M. leprae* gene sequence | :*M. leprae*-specific |
| u0247j | 36797–37066 | *M. leprae* gene sequence | :*M. leprae*-specific |
| u0247k | 5304–5561 | *M. leprae* gene sequence | :*M. leprae*-specific |
| u0247l | 2870–2490 | *M. leprae* gene sequence | :*M. leprae*-specific |
| u0247m | 30111–28738 | *M. leprae* gene sequence | :*M. leprae*-specific |
| u0247n | 28737–28309 | *M. leprae* gene sequence | :*M. leprae*-specific |
| u0247o | 25878–25207 | *M. leprae* gene sequence | :*M. leprae*-specific |
| u0247p | 22881–22054 | *M. leprae* gene sequence | :*M. leprae*-specific |
| u0247q | 15463–15092 | *M. leprae* gene sequence | :*M. leprae*-specific |
| u0247r | 36647–36378 | *M. leprae* gene sequence | :*M. leprae*-specific |
| u0247s | 34199–33831 | *M. leprae* gene sequence | :*M. leprae*-specific |
| u0247t | 28106–27753 | *M. leprae* gene sequence | :*M. leprae*-specific |
| u0247u | 11296–10754 | *M. leprae* gene sequence | :*M. leprae*-specific |
| u0247v | 15883–15497 | *M. leprae* gene sequence | :*M. leprae*-specific |
| u0247w | 22091–21312 | *M. leprae* gene sequence | :*M. leprae*-specific |
| u0247x | 20558–19875 | *M. leprae* gene sequence | :*M. leprae*-specific |
| u0247y | 14366–14088 | *M. leprae* gene sequence | :*M. leprae*-specific |
| u0247z | 10739–10425 | *M. leprae* gene sequence | :*M. leprae*-specific |
| u0247aa | 9839–9510 | *M. leprae* gene sequence | :*M. leprae*-specific |
| u0247ab | 6764–6123 | *M. leprae* gene sequence | :*M. leprae*-specific |
| u0247ac | 4532–4245 | *M. leprae* gene sequence | :*M. leprae*-specific |

*Mycobacterium Leprae* peptides, the functions of such peptides, and nucleotide positions associated with such peptides within Seq. ID No. 134 are summarized in Table XX below.

*Mycobacterium Leprae* peptides, the functions of such peptides, and nucleotide positions associated with such peptides within Seq. ID No. 135 are summarized in Table XXI below.

TABLE XX

| Name | SeqID | Position | Enzyme or Protein Name | Function |
|---|---|---|---|---|
| atp6 | 141 | 14735–13968 | ATP synthase A chain | :metab |
| atpA | 142 | 11700–10009 | ATP synthase alpha chain | :metab |
| atpB | 143 | 9167–7611 | ATP synthase beta chain | :metab |
| atpC | 144 | 13884–13627 | ATP synthase C chain | :metab |
| atpD | 145 | 13120–11747 | ATP synthase delta chain | :metab |
| atpE | 146 | 7596–7213 | ATP synthase epsilon chain | :metab |
| atpF | 147 | 13626–13093 | ATP synthase B chain | :metab |
| atpG | 148 | 10021–9095 | ATP synthase gamma chain | :metab |
| dcda | 149 | 27058–25505 | diaminopimelate decarboxylase | :synth:aa |
| dhom | 150 | 25504–24176 | homoserine dehydrogenase | :synth:aa |
| khse | 151 | 23107–22082 | homoserine kinase | :synth:aa |
| largs | 152 | 29031–26920 | arginyl-tRNA synthetase | :translation |
| murZ | 153 | 5599–4302 | UDP-N-acetylglucosamine 1-carboxyvinyl transferase | :synth:carbo |
| orfWT | 154 | 5657–6256 | *C. freundii* orfW homologue | :*M. leprae* specifi |
| prfA | 155 | 18264–17668 | protein synthesis release factor | :translation |
| rfl | 156 | 19325–18240 | peptide chain release factor 1 | :regulatory |
| rfe | 157 | 16655–15444 | rfe protein | :antigen |
| rho | 158 | 21836–19980 | transcription termination factor R | :regulatory:transc |
| r131 | 159 | 19879–19415 | ribosomal protein L31 | :synth:prot |
| sua5 | 160 | 17342–16674 | yeast SUA5 protein | :mitochondrial |
| thrc | 161 | 24233–23097 | threonine synthase | :synth:aa |
| u471a | 162 | 7212–6763 | *M. leprae* gene sequence | :*M. leprae* specific |
| u471b | 163 | 6400–6624 | *M. leprae* gene sequence | :*M. leprae* specific |
| u471c | 164 | 15190–14720 | *M. leprae* gene sequence | :*M. leprae* specific |
| u471c | 165 | 22118–21837 | *M. leprae* gene sequene | :*M. leprae* specific |
| u471d | 166 | 17762–17376 | *M. leprae* gene sequence | :*M. leprae* specific |

TABLE XXI

| Name | SeqID | Position | Enzyme or Protein Name | Function |
|---|---|---|---|---|
| cciptfd | 167 | 6705–7274 | P450 cytochrome,isopentenyltransf, ferridox. | :synth:antibiotic |
| corA | 168 | 35018–33603 | magnesium and cobalt transport protein | :transport |
| dhps | 169 | 9042–9920 | dihydropteroate synthase | :synth |
| GLGC | 170 | 13535–14827 | glucose-1-phosphate adenylyltransferase | :synth:carbo |
| htra1 | 171 | 21012–22637 | heat shock protein htrA | :antigen:stress |
| malf | 172 | 29904–30938 | maltose transport inner membrane protein | :transport |
| malg | 173 | 30883–31791 | maltose transport inner membrane protein | :transport |
| maox | 174 | 37206–37997 | malate oxireductase(NAD) | :metab |
| mdhc | 175 | 34923–35924 | malate dehydrogenase | :metab |
| mdmc | 176 | 19306–18650 | O-methyltransferase | :synth:nt |
| mg1 | 177 | 11117–11827 | DNA-3-methyladenine glycosidase I | :chemotaxis |
| mrp | 178 | 25338–24019 | MRP protein | :synth |
| rpoE | 179 | 19796–20395 | RNA polymerase sigma-E factor | :regulatory |
| sus1 | 180 | 12702–12388 | sucrose synthase 1 | :synth:carbo |
| thrb2a | 181 | 17482–17144 | TnrB2 protein | :resistance |
| thrb2b | 182 | 17938–17615 | TnrB2 protein | :resistance |
| ugpC | 209 | 31784–32974 | ugpC gene product | :transport |
| u1756a | 183 | 624–941 | *M. leprae* gene sequence | :*M. leprae* specifi |
| u1756b | 208 | 986–161 | serine rich antigen - *M. leprae* | :antigen |
| u1756c | 184 | 1698–2003 | *M. leprae* gene sequence | :*M. leprae* specific |
| u1756d | 185 | 2004–2342 | *M. leprae* gene sequence | :*M. leprae* specific |
| u1756e | 186 | 2511–2870 | *M. leprae* gene sequence | :*M. leprae* specific |
| u1756f | 187 | 3947–2961 | *M. leprae* gene sequence | :*M. leprae* specific |
| u1756g | 188 | 3803–5032 | *M. leprae* gene sequence | :*M. leprae* specific |
| u1756h | 189 | 5234–4989 | *M. leprae* gene sequence | :*M. leprae* specific |
| u1756i | 190 | 5865–5461 | *M. leprae* gene sequence | :*M. leprae* specific |
| u1756j | 191 | 8473–8733 | *M. leprae* gene sequence | :*M. leprae* specific |
| u1756k | 192 | 8619–9041 | *M. leprae* gene sequence | :*M. leprae* specific |
| u1756l | 193 | 9722–10873 | *M. leprae* gene sequence | :*M. leprae* specific |
| u1756m | 194 | 10893–11252 | *M. leprae* gene sequence | :*M. leprae* specific |
| u1756n | 195 | 12026–12268 | *M. leprae* gene sequence | :*M. leprae* specific |
| u1756o | 196 | 13176–12772 | *M. leprae* gene sequence | :*M. leprae* specific |
| u1756p | 197 | 14898–15554 | *M. leprae* gene sequence | :*M. leprae* specific |

TABLE XXI-continued

| Name | SeqID | Position | Enzyme or Protein Name | Function |
|---|---|---|---|---|
| u1756q | 198 | 15921–15505 | M. leprae gene sequence | :M. leprae specific |
| u1756r | 199 | 16551–16129 | M. leprae gene sequence | :M. leprae specific |
| u1756s | 200 | 17051–16577 | M. leprae gene sequence | :M. leprae specific |
| u1756t | 201 | 18229–17957 | M. leprae gene sequence | :M. leprae specific |
| u1756u | 202 | 19570–19944 | M. leprae gene sequence | :M. leprae specific |
| u1756v | 203 | 27394–26282 | M. leprae gene sequence | :M. leprae specific |
| u1756w | 204 | 28547–30938 | M. leprae gene sequence | :M. leprae specific |
| u1756x | 205 | 36803–37099 | M. leprae gene sequence | :M. leprae specific |
| u1756y | 206 | 37769–38674 | M. leprae gene sequence | :M. leprae specific |
| u1756z | 207 | 22634–22999 | M. leprae gene sequence | :M. leprae specific |

*Mycobacterium Leprae* peptides, the functions of such peptides, and nucleotide positions associated with such peptides within Seq. ID No. 136 are summarized in Table XXII below.

TABLE XXII

| Name | SeqID | Position | Enzyme or Protein Name | Function |
|---|---|---|---|---|
| 4CL1 | 210 | 33126–31948 | 4-Coumarate-CoA ligase | :metab |
| ag84 | 211 | 27120–26890 | antigen Ag84 | :antigen |
| anp4 | 212 | 31293–31631 | antifreeze peptide 4 precursor | :regulatory |
| cpsA | 213 | 20816–22444 | cpsA gene product | :synth:carbo |
| DHG | 214 | 22804–22529 | glucose 1-dehydrogenase | :synth:carbo |
| DHMA | 215 | 23283–23074 | N-acylmannosamine 1-dehydrogenase | :synth:carbo |
| glvr1 | 216 | 35001–33718 | glvr-1 protein | :antibiotic |
| mtrA | 217 | 9475–8901 | phosphate regulatory protein(*M. tuberculosis*) | :regulatory |
| otsa | 218 | 27834–29330 | alpha,alpha-trehalose-phosphate synthase | :redox |
| pkc1 | 219 | 6931–7422 | protein kinase C inhibitor 1 | :regulatory |
| pur2 | 220 | 5183–3909 | phosphoribosylamine-glysine ligase | :synth |
| srcO | 221 | 18805–18602 | sarcosine oxidase | :catab |
| u296a | 222 | 315–1 | *M. leprae* gene sequence | :*M. leprae* specific |
| u296b | 223 | 1966–1733 | *M. leprae* gene sequence | :*M. leprae* specific |
| u296c | 224 | 3256–3534 | *M. leprae* gene sequence | :*M. leprae* specific |
| u296d | 225 | 5498–5184 | *M. leprae* gene sequence | :*M. leprae* specific |
| u296e | 226 | 6019–5636 | *M. leprae* gene sequence | :*M. leprae* specific |
| u296f | 227 | 6259–6576 | *M. leprae* gene sequence | :*M. leprae* specific |
| u296g | 228 | 8070–7768 | *M. leprae* gene sequence | :*M. leprae* specific |
| u296g | 229 | 8488–8727 | *M. leprae* gene sequence | :*M. leprae* specific |
| u296h | 230 | 10580–10371 | *M. leprae* gene sequence | :*M. leprae* specific |
| u296i | 231 | 11570–11280 | *M. leprae* gene sequence | :*M. leprae* specific |
| u296j | 232 | 12480–11617 | hypothetical 26.6K protein (*M. fortuitum*) | :*M. leprae* specifi |
| u296k | 233 | 15238–15053 | *M. leprae* gene sequence | :*M. leprae* specific |
| u296l | 234 | 16952–17338 | *M. leprae* gene sequence | :*M. leprae* specific |
| u296m | 235 | 17578–17276 | *M. leprae* gene sequence | :*M. leprae* specinc |
| u296n | 236 | 18592–18293 | *M. leprae* gene sequence | :*M. leprae* specific |
| u296o | 237 | 20439–20239 | *M. leprae* gene sequence | :*M. leprae* specific |
| u296p | 238 | 20685–20894 | *M. leprae* gene sequence | :*M. leprae* specific |
| u296q | 239 | 23759–23992 | *M. leprae* gene sequence | :*M. leprae* specific |
| u296r | 240 | 23878–24234 | *M. leprae* gene sequence | :*M. leprae* specific |
| u296s | 241 | 26577–26338 | *M. leprae* gene sequence | :*M. leprae* specliic |
| u296t | 242 | 30960–30700 | *M. leprae* gene sequence | :*M. leprae* specific |
| u296u | 243 | 33751–33431 | *M. leprae* gene sequence | :*M. leprae* specific |
| u296v | 244 | 33437–33099 | *M. leprae* gene sequence (ATP site) | :*M. leprae* specific |
| u296w | 245 | 35512–35060 | *M. leprae* gene sequence | :*M. leprae* specific |

*Mycobacterium Leprae* peptides, the functions of such peptides, and nucleotide positions associated with such peptides within Seq. ID No. 137 are summarized in Table XXIII below.

TABLE XXIII

| Name | SeqID | Position | Enzyme or Protein Name | Function |
|---|---|---|---|---|
| ampL | 246 | 675–2018 | vacular aminopeptidase I precusor | :metab:protein |
| glnR | 247 | 22621–22818 | GlnR protein (response regulator; similar to phoP) | :regulatory |
| gocp | 248 | 7775–6135 | capsule gene complex(galE)(rfbB)(rfbC/D) | :synth:carbo |
| icc | 249 | 5243–6220 | ICC protein | :regulatory |

TABLE XXIII-continued

| Name | SeqID | Position | Enzyme or Protein Name | Function |
|---|---|---|---|---|
| ntrB | 250 | 31848–30655 | ntrB gene | :regulatory |
| pdp | 251 | 23955–25253 | phosp-repressible,periplasmicphosph.-binding prot | :transport |
| phoB | 252 | 28555–27839 | phosphate regulatory protein | :transport |
| pstA | 253 | 26324–26926 | phosphate transport protein PSTA | :transport |
| pstB | 254 | 26991–27812 | phosphate transport protein PSTB | :transport |
| pstC | 255 | 25357–25863 | phosphate transport protein | :transport |
| pur1 | 256 | 9799–11472 | aminophosphoribosyl transferase precursor | :synth:nt |
| pur5 | 257 | 11547–12140 | phosphoribosylformulglycinamidine cyclo-ligase | :synth:nt |
| purL | 258 | 2834–5134 | Phosphoribosylformylglycinamidine | :synth:nt |
| purM | 259 | 12023–12664 | phosphoribosylamine-glycine ligase | :synth:nt |
| stad | 260 | 32890–31853 | [acyl-carrier protein] desaturase precusorR | :synth:lipid |
| thi1 | 261 | 21277–20753 | thioredoxin | :redox |
| thtr | 262 | 20164–19190 | thiosulfate sulfurtransferase | :synth:aa |
| u2266a | 263 | 286–81 | *M. leprae* gene sequence | :*M. leprae* specific |
| u2266b | 264 | 512–309 | *M. leprae* gene sequence | :*M. leprae* specific |
| u2266c | 265 | 793–332 | *M. leprae* gene sequence | :*M. leprae* Specific |
| u2266d | 266 | 8748–8509 | *M. leprae* gene sequence | :*M. leprae* specific |
| u2266e | 267 | 8960–8721 | *M. leprae* gene sequence | :*M. leprae* specific |
| u2266f | 268 | 14252–13113 | *M. leprae* gene sequence | :*M. leprae* specific |
| u2266g | 269 | 15539–15751 | *M. leprae* gene sequence | :*M. leprae* specific |
| u2266h | 270 | 15996–15757 | *M. leprae* gene sequence | :*M. leprae* specific |
| u2266i | 271 | 18690–17941 | *M. leprae* gene sequence | :*M. leprae* specific |
| u2266j | 272 | 19344–18886 | *M. leprae* gene sequence | :*M. leprae* specific |
| u2266k | 273 | 20639–20055 | *M. leprae* gene sequence | :*M. leprae* specific |
| u2266l | 274 | 20752–20537 | *M. leprae* gene sequence | :*M. leprae* specific |
| u2266m | 275 | 22137–21268 | *M. leprae* gene sequence | :*M. leprae* specific |
| u2266n | 276 | 23030–23971 | *M. leprae* gene sequence | :*M. leprae* specific |
| u2266o | 277 | 29564–28860 | *M. leprae* gene sequence | :*M. leprae* specific |
| u2266p | 278 | 33161–32964 | *M. leprae* gene sequence | :*M. leprae* specific |
| u2266q | 279 | 37362–36865 | *M. leprae* gene sequence | :*M. leprae* specific |
| u2266r | 280 | 37443–37745 | *M. leprae* gene sequence | :*M. leprae* specific |
| u2266s | 281 | 38205–38435 | *M. leprae* gene sequence | :*M. leprae* specific |
| u2266t | 282 | 39609–39872 | *M. leprae* gene sequence | :*M. leprae* specific |

*Mycobacterium Leprae* peptides, the functions of such peptides, and nucleotide positions associated with such peptides within Seq. ID No. 138 are summarized in Table XXIV below.

TABLE XXIV

| Name | SeqID | Position | Enzyme or Protein Name | Function |
|---|---|---|---|---|
| 4c11 | 283 | 32892–34358 | 4-coumarate-coA ligase | :repair |
| cut | 284 | 9824–10657 | deoxyuridine 5'-triphosphate nucleotidohydrolase | :metab:nt |
| dcup | 285 | 23904–25109 | uroporphyrinogen decarboxylase | :synth |
| hemy | 286 | 24716–26461 | hemy protein | :synth |
| msg45mp | 287 | 16345–15056 | *M. leprae* gene sequence | :transport |
| myoP | 288 | 7650–8537 | myo-inositol-1(OR 4)-monophosphatase | :antigen |
| rps | 289 | 6746–5004 | DNA-directed RNA polymerase sigma | :regulatory:transc |
| tkt | 290 | 16569–18965 | transketolase | :transport |
| traA | 291 | 35961–34381 | possible transcriptional activator (srmR) | :regulatory |
| u1764a | 292 | 1187–150 | DNA-directed RNA polymerase | :regulatory:transc |
| u1764aa | 293 | 28189–27923 | *M. leprae* gene sequence | :*M. leprae* specific |
| u1764ab | 294 | 28583–28398 | *M. leprae* gene sequence | :*M. leprae* specific |
| u1764ac | 295 | 28952–29299 | *M. leprae* gene sequence | :*M. leprae* specific |
| u1764ad | 296 | 30616–30837 | *M. leprae* gene sequence | :*M. leprae* specific |
| u1764ae | 297 | 31124–31477 | *M. leprae* gene sequence | :*M. leprae* specific |
| u1764af | 298 | 31478–31675 | *M. leprae* gene sequence | :*M. leprae* specific |
| u1764b | 299 | 1776–1276 | *M. leprae* gene sequence | :*M. leprae* specific |
| u1764c | 300 | 1687–2046 | *M. leprae* gene sequence | :*M. leprae* specific |
| u1764d | 301 | 3055–2033 | *M. leprae* gene sequence | :*M. leprae* specific |
| u1764e | 302 | 3610–3260 | *M. leprae* gene sequence | :*M. leprae* specific |
| u1764f | 303 | 4856–4431 | *M. leprae* gene sequence | :*M. leprae* specific |
| u1764fg | 304 | 8124–6739 | *M. leprae* gene sequence | :*M. leprae* specific |
| u1764h | 305 | 9200–8541 | *M. leprae* gene sequence | :*M. leprae* specific |
| u1764i | 306 | 10278–9694 | *M. leprae* gene sequence | :*M. leprae* specific |
| u1764j | 307 | 9375–9689 | *M. leprae* gene sequence | :*M. leprae* specific |
| u1764k | 308 | 10570–11475 | *M. leprae* gene sequence | :*M. leprae* specific |
| u1764l | 309 | 12239–11520 | *M. leprae* gene sequence | :*M. leprae* specific |

TABLE XXIV-continued

| Name | SeqID | Position | Enzyme or Protein Name | Function |
|---|---|---|---|---|
| u1764m | 310 | 12539–12772 | M. leprae gene sequence | :M. leprae specific |
| u1764n | 311 | 13087–13278 | M. leprae gene sequence | :M. leprae specific |
| u1764o | 312 | 14085–14282 | M. leprae gene sequence | :M. leprae specific |
| u1764p | 313 | 14568–14756 | M. leprae gene sequence | :M. leprae specific |
| u1764q | 314 | 16964–16398 | M. leprae gene sequence | :M. leprae specific |
| u1764r | 315 | 18966–19160 | M. leprae gene sequence | :M. leprae specific |
| u1764s | 316 | 19585–20049 | M. leprae gene sequence | :M. leprae specific |
| u1764t | 317 | 20669–21169 | M. leprae gene sequence | :M. leprae specific |
| u1764u | 318 | 22490–21066 | M. leprae gene sequence | :M. leprae specific |
| u1764v | 319 | 22953–22357 | M. leprae gene sequence | :M. leprae specific |
| u1764w | 320 | 23419–23063 | M. leprae gene sequence | :M. leprae specific |
| u1764x | 321 | 23773–23468 | M. leprae gene sequence | :M. leprae specific |
| u1764y | 322 | 26203–27162 | M. leprae gene sequence | :M. leprae specific |
| u1764z | 323 | 27612–27869 | M. leprae gene sequence | :M. leprae specific |

Mycobacterium Leprae peptides, the functions of such peptides, and nucleotide positions associated with such peptides within Seq. ID No. 139 are summarized in Table XXV below.

Mycobacterium Leprae peptides, the functions of such peptides, and nucleotide positions associated with such peptides within Seq. ID No. 140 are summarized in Table XXVI below.

TABLE XXV

| Name | SeqID | Position | Enzyme or Protein Name | Function |
|---|---|---|---|---|
| achA | 324 | 2747–3214 | acetyl-hydrolase | :regulatory:transp |
| cys | 325 | 3622–5029 | cysteine synthase | :synth:aa |
| dhay | 326 | 16015–15797 | aldehyde dehydrogenase (NAD+) | :metab |
| eutP1 | 327 | 15605–15339 | ethanolamine permease (eutP) gene | :transport |
| eutP2 | 328 | 15289–15101 | ethanolamine permease (eutP) gene | :transport |
| grea | 329 | 7902–7237 | transcription elongation factor GREA | :regulatory:transc |
| kre1 | 330 | 18977–19327 | weak homolog of Saccharomyces cerevisiae KRE1 | :synth:cell wall |
| lmbE | 331 | 8458–9366 | lmbE gene product | :synth |
| metB | 332 | 6002–7174 | cystathionine gamma-synthase | :synth:aa |
| prAG | 333 | 5140–5928 | proline-rich antigen | :antigen |
| u1740 | 334 | 1795–1463 | weak match to tyrocidine synthetase I | :M. leprae specific |
| u1740a | 335 | 3–296 | M. leprae gene sequence | :M. leprae specific |
| u1740aa | 336 | 29246–29563 | M. leprae gene sequence | :M. leprae specific |
| u1740ab | 337 | 29952–30137 | M. leprae gene sequence | :M. leprae specific |
| u1740ac | 338 | 30331–30693 | M. leprae gene sequence | :M. leprae speclfic |
| u1740ad | 339 | 30879–30550 | M. leprae gene sequence | :M. leprae specific |
| u1740ae | 340 | 30861–31070 | M. leprae gene sequence | :M. leprae specific |
| u1740af | 341 | 32594–33013 | M. leprae gene sequence | :M. leprae specific |
| u1740ag | 342 | 36000–36353 | M. leprae gene sequence | :M. leprae specific |
| u1740ah | 343 | 36801–36322 | M. leprae gene sequence | :M. leprae specific |
| u1740ai | 344 | 32476–32718 | M. leprae gene sequence | :M. leprae specific |
| u1740aj | 345 | 15049–14792 | M. leprae gene sequence | :M. leprae specific |
| u1740b | 346 | 9141–9668 | M. leprae gene sequence | :M. leprae specific |
| u1740c | 347 | 9502–9927 | M. leprae gene sequence | :M. leprae specific |
| u1740d | 348 | 9824–10078 | M. leprae gene sequence | :M. leprae specific |
| u1740e | 349 | 10059–10307 | M. leprae gene sequence | :M. leprae seecific |
| u1740f | 350 | 10271–10705 | M. leprae gene sequence | :M. leprae specific |
| u1740g | 351 | 11468–11716 | M. leprae gene sequence | :M. leprae specific |
| u1740h | 352 | 12672–12361 | M. leprae gene sequence | :M. leprae specific |
| u1740i | 353 | 14108–12684 | lipoamide dehydrogenase | :catab |
| u1740j | 354 | 14584–14219 | M. leprae gene sequence | :M. leprae specific |
| u1740k | 355 | 16311–15868 | M. leprae gene sequence | :M. leprae specific |
| u1740l | 356 | 16448–16176 | aldehyde dehydrogenase | :catab:aa |
| u1740m | 357 | 17439–17735 | M. leprae gene sequence | :M. leprae specific |
| u1740n | 358 | 17701–17949 | M. leprae gene sequence | :M. leprae specific |
| u1740o | 359 | 18415–18858 | prolyl endopeptidase | :catab |
| u1740p | 360 | 19727–19461 | M. leprae gene sequence | :M. leprae specific |
| u1740q | 361 | 19621–20019 | M. leprae gene sequence | :M. leprae specific |
| u1740r | 362 | 21077–20697 | M. leprae gene sequence | :M. leprae specific |
| u1740s | 363 | 24193–21263 | transport protein | ;transport:antibiot |
| u1740t | 364 | 24672–24139 | M. leprae gene sequence | :M. leprae specific |
| u1740u | 365 | 24695–24880 | M. leprae gene sequence | :M. leprae specific |
| u1740v | 366 | 24881–25093 | M. leprae gene sequence | :M. leprae specific |
| u1740w | 367 | 25762–25944 | M. leprae gene sequence | :M. leprae specific |
| u1740x | 368 | 26293–26742 | M. leprae gene sequence | :M. leprae specific |
| u1740y | 369 | 27179–28414 | transport protein | ;transport:antibiot |
| u1740z | 370 | 28620–28907 | M. leprae gene sequence | :M. leprae specific |

TABLE XXVI

| Name | SeqID | Position | Enzyme or Protein Name | Function |
|---|---|---|---|---|
| accY | 371 | 32168–32404 | weak match to acetyl-Co-Acarboxylase carboxyltrans. | :metab |
| atcB | 372 | 27392–27045 | calcium-transportin ATPase | :transport |
| atnA | 373 | 27907–27596 | Na+, K+-ATPase alpha subunit | :transport |
| b650 | 374 | 19208–18924 | *M. leprae* gene sequence | :*M. leprae* specific |
| b650 | 375 | 19585–19325 | *M. leprae* gene sequence | :*M. leprae* specific |
| phoP | 376 | 35833–36063 | alk phosph syn transcriptional regulatory protein | :regulalory:transc |
| pstA | 377 | 1914–871 | phosphate transport protein PSTA | :transport |
| pstC | 378 | 2804–1803 | phosphate transport protein PSTC | :transport |
| pstS | 379 | 3923–2805 | phosphate-repressible, periplasmic | :transport |
| smf2 | 380 | 6236–7522 | SMF2 protein | :resistance |
| znfy1 | 410 | 31567–32214 | zinc finger protein | :regulatory |
| znfy2 | 411 | 31347–31709 | zinc finger protein | :regulatory |
| u650 | 381 | 24796–24281 | *M. leprae* gene sequence | :*M. leprae* specific |
| u650 | 382 | 27595–27386 | *M. leprae* gene sequence | :*M. leprae* specific |
| u650a | 383 | 4393–4013 | *M. leprae* gene sequence | :*M. leprae* specific |
| u650a | 384 | 285–37 | *M. leprae* gene sequence | :*M. leprae* specific |
| u650ab | 385 | 32699–32932 | *M. leprae* gene sequence | :*M. leprae* specific |
| u650ac | 386 | 33365–33613 | *M. leprae* gene sequence | :*M. leprae* specific |
| u650b | 387 | 4523–4840 | *M. leprae* gene sequence | :*M. leprae* specific |
| u650e | 388 | 5417–5632 | *M. leprae* gene sequence | :*M. leprae* specific |
| u650f | 389 | 8177–7995 | *M. leprae* gene sequence | :*M. leprae* specific |
| u650g | 390 | 8860–8624 | *M. leprae* gene sequence | :*M. leprae* specific |
| u650h | 391 | 10471–10154 | *M. leprae* gene sequence | :*M. leprae* specific |
| u650i | 392 | 10711–10472 | *M. leprae* gene sequence | :*M. leprae* specific |
| u650j | 393 | 10880–11248 | *M. leprae* gene sequence | :*M. leprae* specific |
| u650k | 394 | 12043–12450 | *M. leprae* gene sequence | :*M. leprae* specific |
| u650l | 395 | 13094–12894 | *M. leprae* gene sequence | :*M. leprae* specific |
| u650m | 396 | 14944–15813 | *M. leprae* gene sequence | :*M. leprae* specific |
| u650n | 397 | 15878–16153 | *M. leprae* gene sequence | :*M. leprae* specific |
| u650o | 398 | 16958–16734 | *M. leprae* gene sequence | :*M. leprae* specific |
| u650p | 399 | 18652–18467 | *M. leprae* gene sequence | :*M. leprae* specific |
| u650q | 400 | 20450–20656 | *M. leprae* gene sequence | :*M. leprae* specific |
| u650r | 401 | 22198–22539 | *M. leprae* gene sequence | :*M. leprae* specific |
| u650s | 402 | 22591–22776 | *M. leprae* gene sequence | :*M. leprae* specific |
| u650t | 403 | 22777–22959 | lignostilbene alphabeta-dioxygenase | :catab |
| u650u | 404 | 25611–25315 | *M. leprae* gene sequence | :*M. leprae* specific |
| u650v | 405 | 26166–25612 | *M. leprae* gene sequence | :*M. leprae* specific |
| u650w | 406 | 28135–27908 | *M. leprae* gene sequence | :*M. leprae* specific |
| u650x | 407 | 28993–28640 | *M. leprae* gene sequence | :*M. leprae* specific |
| u650y | 408 | 29213–28989 | *M. leprae* gene sequence | :*M. leprae* specific |
| u650z | 409 | 31263–30511 | 4-chlorobenzoate-CoA dehalogenase | :snyth:lipid |
| dnfa | 410 | 31567–32214 | zinc finger protein | :regulatory |
| dnfb | 411 | 31347–31709 | zinc finger protein | :regulatory |

Proteins and peptides of the present invention have further utility for use as vaccines or as screens for new tuberculosis drugs. The purified proteins derived from *Mycobacterium tuberculosis* or *leprae* may elicit a specific immune response. The production of purified proteins by recombinant means is not limited to the use of pathogenic bacteria. The proteins of this invention, derived from *M. tuberculosis* or *M. leprae*, may also be expressed in *M. bovis*-BCG by recombinant means, and the resulting recombinant BCG cells may be used as a vaccine. See published PCT application WO90/00594, for example.

The availability of large quantities of *Mycobacterium tuberculosis* and/or *leprae* proteins and peptides allows the use of such proteins and peptides as specific binding agents for drugs. The proteins and peptides may also be used to elicit immune responses for the development of antibodies. Such antibodies may have therapeutic value. Proteins and peptides may also be used diagnostically to detect hypersensitivity reactions of individuals exposed to *Mycobacterium tuberculosis* or *leprae*. The proteins and peptides may be affixed to solid supports to detect antibodies from patient's sera typical of hypersensitivity reactions.

For example, one method comprises the step of forming an admixture of a sera of an individual with a peptide corresponding to a peptide of *Mycobacterium tuberculosis* or *leprae*. Upon imposition of reaction conditions in the presence of an antibody to the peptide, an affinity complex forms. The method further includes the step of detecting the affinity complex which affinity complex is indicative of the presence of a hypersensitivity reaction.

One embodiment of the present invention features, as an article of manufacture, a kit comprising a non-naturally occurring nucleic acid corresponding to *Mycobacterium tuberculosis* or *leprae* nucleic acid. A further embodiment of the present invention features a kit comprising a non-naturally occurring peptide corresponding to a peptide of *Mycobacterium tuberculosis* or *leprae* or an antibody capable of binding such peptides.

These and other features will be apparent to individuals skilled in the art upon reading the detailed description of the present invention.

DETAILED DECSRIPTION

The present invention relates to nucleic acid and amino acid sequences relating to *Mycobacterium tuberculosis* and *leprae*. As used herein, the term "*Mycobacterium tuberculosis*" is used in the sense of the causative agent of tuberculosis in humans. The term "*Mycobacterium leprae*" refers to the causative agent of leprosy in humans.

As used herein the term "corresponding to", referring to a nucleic acid, means nucleotides in a sequence which is homologous or complementary to other nucleic acid or with reference to a peptide, homologous or complementary to the nucleic acid which encodes such peptides. The derived nucleic acid may be generated in any manner, including, for example, chemical synthesis, or DNA polymerase or reverse transcription which are based on the sequence information.

Similarly, the term "corresponding to", referring to a peptide or a protein, means having an amino acid sequence encoded by a designated nucleic acid sequence, or which is immunologically identical with a peptide encoded in the sequence, or having the amino acid sequence of a designated peptide. The peptide encoded by the sequence is the gene product. A corresponding peptide is not necessarily translated from a corresponding nucleic acid sequence but may be generated in any manner, including, for example, chemical synthesis, or expression of a recombinant expression system or isolation from mutated *Mycobacterium tuberculosis* or *leprae*.

The term "non-naturally occurring nucleic acid" comprises genomic, synthetic DNA, semi-synthetic, or a synthetic nucleic acid which by virtue of its origin or manipulation is not associated with all or a portion of the nucleic acid with which it is associated in nature, and/or in a form of a library, and/or is linked to a nucleic acid other than that to which it is linked in nature. The term "associated with" is used to denote linkage such as that between adjacent segments of nucleic acid.

"Host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

The term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site and terminators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

The term "operably linked" refers to sequences joined or ligated to function in their intended manner. For example, a control sequence is operably linked to coding sequence by ligation in such a way that expression of the coding sequence is achieved under conditions compatible with the control sequence and lost cell.

An "open reading frame" is a region of nucleic acid which encodes a peptide. This region may represent a portion of a coding sequence or a total sequence.

A "coding sequence" is a nucleic acid sequence which is transcribed into messenger RNA and/or translated into a peptide when placed under the control of appropriate regulatory sequences. The boundaries of the coding sequence are determined by a translation start code at the five prime terminus and a translation stop code at the three prime terminus. A coding sequence can include but is not limited to messenger RNA, synthetic DNA, and recombinant nucleic acid sequences.

A "gene product" is a protein or structural RNA which is specifically encoded for by a gene.

The term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation. The experimental manipulation of such conditions has been well described in the literature including such books as *Molecular Cloning; A Laboratory Manual*, Sambrook, J., Fritsch, E. F., Maniatis, T., Cold Spring Harbor Laboratory Press, Cold Spring Harbor, 2nd ed. (1989).

The term "primer" is used to denote nucleic acid capable of binding to a specific sequence and initiating a polymerase reaction.

The practice of the present invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; A Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.) and *PCR-A Practical Approach* (McPherson, Quirke, and Taylor, eds., 1991).

The DNA sequences relating to *Mycobacterium tuberculosis* are derived from nucleic acid sequences present in *Mycobacterium tuberculosis*. *Mycobacterium tuberculosis* from which the sequences are derived was acquired from the American Type Culture Collection and has an ATCC designation 25618. This particular *Mycobacterium tuberculosis* has features which are consistent with those described of *Mycobacterium tuberculosis* in general and is believed to be representative of all *Mycobacterium tuberculosis*. The *Mycobacterium tuberculosis* of the deposit is available through the catalogue of the American Type Culture Collection without restriction. It is believed the *Mycobacterium tuberculosis* of the deposit has been and is widely available.

The nucleic acid sequences of this invention may be obtained directly from the DNA of the above referenced *Mycobacteria tuberculosis* strain by using the polymerase chain reaction (PCR). See *"PCR, A Practical Approach"* (McPherson, Quirke, and Taylor, eds., IRL Press, Oxford, UK, 1991) for details about the PCR. Alternatively, the sequences of this invention may be obtained from libraries of Mycobacteria DNA fragments carried in clones of suitable host organisms such as *E. coli*. Suitable libraries include those of Eiglmeier et al. (1993, Mol. Microbiol. 7, 197–206)

and Clark-Curtiss et al. (1985, J. Bacteriol. 161, 1093–1102) for *M. leprae* and those of Kalpana et al. (1991, Proc. Natl. Acad. Sci. USA 88, 5433–5437) and Bhargava et al. (1990, J. Bacteriol. 172, 2930–2934) for *M. tuberculosis*. Clones carrying the desired sequences described in this invention may be obtained by screening the libraries by means of the PCR or by hybridization of synthetic oligonucleotide probes to filter lifts of the library colonies or plaques as known in the art (see, eg, Sambrook et al., "*Molecular Cloning, A Laboratory Manual*" 2nd edition, 1989, Cold Spring Harbor Press, NY).

Nucleic acids isolated or synthesized in accordance with features of the present invention are useful, by way of example, without limitation, as probes, primers, capture ligands, anti-sense genes and for developing expression systems for the synthesis of proteins and peptides corresponding to such sequences.

As probes, primers, capture ligands and anti-sense agents, the nucleic acid will normally comprise approximately twenty or more nucleotides for specificity as well as the ability to form stable hybridization products.

Probes

A nucleic acid isolated or synthesized in accordance with Seq. ID No. 1 or Seq. ID Nos. 23–26 and 120–140 can be used as a probe to specifically detect *Mycobacterium tuberculosis* or *M. leprae*, respectively. With the sequence information set forth in the present application, sequences of twenty or more nucleotides are identified which provide the desired inclusivity and exclusivity with respect to *Mycobacterium tuberculosis* and/or *M. leprae*, and extraneous nucleic acid sequences likely to be encountered during hybridization conditions. More preferably, the sequence will comprise at least twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acid sequences, for use as probes, can be provided with a label to facilitate detection of a hybridization product.

Nucleic acid isolated and synthesized in accordance with Seq. ID No. 1 or Seq. ID Nos. 23–26 and 120–140 may also be useful as probes to detect homologous regions (especially homologous genes) of *M. tuberculosis, M. leprae, M. avium, M. bovis*, or other mycobacterial species using relaxed stringency hybridization conditions, as will be obvious to anybody skilled in the art.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence corresponding to Seq. ID No. 1 with respect to *Mycobacterium tuberculosis*, or Seq. ID Nos. 23–26 and 120–140 with respect to *Mycobacterium M. leprae* have utility to separate *Mycobacterium tuberculosis* or *leprae* nucleic acid from the nucleic acid of each other and other organisms. Nucleic acid having twenty or more nucleotides in a sequence corresponding to Seq. ID Nos. 1 and 23–26 and 120–140 may also have utility to separate *M. avium* or *M. bovis* or other mycobacterial species from each other and from other organisms. Preferably, the sequence will comprise at least twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *Mycobacterium tuberculosis* and *M. leprae* nucleic acid. These nucleic acids may also have utility as primers for the amplification of nucleic acid sequences in *M. avium, M. bovis*, or other mycobacterial species. With respect to polymerase chain reaction (PCR) techniques, nucleic acid sequences of twenty or more nucleotides corresponding to Seq. ID No. 1 or Seq. ID Nos. 23–26 and 120–140 have utility in conjunction with suitable enzymes and reagents to create copies of *Mycobacterium tuberculosis* and/or *leprae* nucleic acid. More preferably, the sequence will comprise twenty to thirty nucleotides to convey stability to the hybridization product formed between the probe and the intended target molecules. Sequences larger than 1000 nucleotides in length are difficult to synthesize but can be generated by recombinant DNA techniques. Binding conditions of probes greater than 100 nucleotides are more difficult to control to obtain specificity.

The copies can be used in diagnostic assays to detect specific sequences, including genes *Mycobacterium tuberculosis* and/or *M. leprae* and/or *M. avium, M. bovis*, or other mycobacteria species. The copies can also be incorporated into cloning and expression vectors to generate polypeptides corresponding to the nucleic acid synthesized by PCR, as will be described in greater detail below.

Anti-sense

Nucleic acid or nucleic acid-hybridizing derivatives isolated or synthesized in accordance with the sequences described herein have utility as anti-sense agents to prevent the expression of *Mycobacterium tuberculosis* or *M. leprae* genes. These sequences may also have utility as anti-sense agents to prevent expression of genes of *M. avium, M. bovis*, or other mycobacteria species.

Nucleic acid or derivatives corresponding to *Mycobacterium tuberculosis* or *M. leprae* nucleic acid sequences is loaded into a suitable carrier such as a liposome or mycobacteriaphage for introduction into a mycobacterial cells. For example, a nucleic acid having twenty or more nucleotides is capable of binding to bacteria nucleic acid or bacteria messenger RNA. Preferably, the anti-sense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading anti-sense nucleic acid in liposomes is known in the art as exemplified by U.S. Pat. No. 4,241,046 issued Dec. 23, 1980 to Papahadjopoulos et al.

Expressing Mycobacterial Genes

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression could be accomplished in a mutant strain which lacks the activity of the gene to be tested, or in a strain that does not produce the same gene product(s). This includes, but is not limited to, mycobacterial strains such as BCG and *M. Smegmatis*, and other bacterial strains such as *E. coli*, Norcardia, Corynebacterium, and Streptomyces species. In some cases the expression host will utilize the natural mycobacterial promoter whereas in others, it will be necessary to drive the gene with a promoter sequence derived from the expressing organism (e.g., an *E. coli* beta-galactosidase promoter for expression in *E. coli*).

To express a gene product using the natural mycobacterial promoter, a procedure such as the following is used. A restriction fragment containing the gene of interest, together with its associated natural promoter elements and regulatory sequences (identified using the DNA sequence data) is cloned into an appropriate recombinant plasmid containing the following components: an origin of replication that functions in the host organism, and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into to expression plasmid after treating the PCR product with a restriction enzyme or exonuclease to create suitable ends for cloning.

Expressed Genes in Therapeutics

Nucleic acid isolated or synthesized in accordance with the sequences described herein have utility to generate proteins and peptides. The nucleic acid exemplified by Seq. ID No. 1 or Seq. ID No. 23–26 and 120–140 can be cloned into suitable vectors or used to isolate nucleic acid. The isolated nucleic acid is combined with suitable DNA linkers and cloned into a suitable vector. The vector can be used to transform a suitable host organism such as *E. coli* and the peptide or protein encoded by the sequences isolated.

Molecular cloning techniques are described in the text *Molecular Cloning: A Laboratory Manual*, 2nd edition, Sambrook et al., Coldspring Harbor Laboratory (1989). The isolated peptide has utility as an antigenic substance for the development of vaccines and antibodies directed to *Mycobacterium tuberculosis* or *M. leprae*.

The isolated protein or peptide also has utility in screening assays to identify inhibitors or potentiators of the activity of said protein or peptide. Such inhibitors or potentiators may be useful as new therapeutic agents to combat Mycobacterial infections in man. Screening assays may be constructed in vitro with purified Mycobacterial enzyme such that the action of the enzyme produces an easily detectable reaction product. Suitable products include those with distinctive absorption, fluorescence, or chemi-luminescence properties, for example, because detection may be easily automated. A variety of synthetic or naturally occurring compounds may be tested in the assay to identify those which inhibit or potentiate the activity of the mycobacterial enzyme. Some of these active compounds may directly, or with chemical alterations to promote membrane permeability or solubility, also inhibit or potentiate the same enzymatic activity in whole, live mycobacterial cells. Such compounds may be used as anti-mycobacterials in therapy. Since cells of *M. tuberculosis* and *M. leprae* grow poorly or not at all in culture, in vitro assays with isolated *M. tuberculosis* or *M. leprae* enzymes provide a practical approach for detecting potential new therapeutic agents.

Alternatively, new therapeutic agents may be discovered by use of screening assays which incorporate the *M. tuberculosis* or *leprae* genes of this invention or fragments thereof into other micro-organisms such as other Mycobacteria species. For example, *M. tuberculosis* or *M. leprae* genes expressed in heterologous micro-organisms may create new products whose activity or presence can be assayed. Agents which alter the activity or presence of these products may be useful therapeutic agents to combat *M. tuberculosis* or *M. leprae* infections in man. This approach is useful even when the function or activity of the protein or enzyme encoded by the gene is poorly understood or difficult to assay. Preferably, the genes are essential for growth or viability of the organism. *Mycobacteria smegmatis* and *M. bovis* are non-pathogenic but are closely related to *M. tuberculosis* and *M. leprae* and are much easier to grow and manipulate in culture. Molecular genetic methods permit the transformation of *M. bovis* and *M. smegmatis* with autonomously replicating vectors and with integrating vectors capable of carrying new genes. See, for example, details provided in published PCT applications WO 88/06626, WO 90/00594, WO 92/01783, WO 92/01796, and WO 92/22326.

This methodology may be used to replace *M. bovis* or *M. smegmatis* genes with their *M. tuberculosis* or *M. leprae* homologs provided in this invention. For example, the *M. bovis* or *M. smegmatis* gene which is homologous to the *M. tuberculosis* or *M. leprae* gene of interest is identified from appropriate clone libraries (see, for example, Kalpana et al., 1991, Proc. Natl. Acad. Sci. USA 88, 5433–5437) by colony or plaque hybridization using the *M. tuberculosis* or *M. leprae* genes of this invention or fragments thereof as probes. The resulting *M. bovis* or *M. smegmatis* gene is rendered non-functional by disruption or deletion of the coding region and re-introduced into *M. bovis* or *M. smegmatis* by homologous recombination as a linear fragment (see Kalpana et al., 1991, above). Homologous replacements may be distinguished from the background of illegitimate integrations-by using the PCR with appropriate primers. Nested PCR primers may be used in a two-stage PCR to increase specificity if necessary as is known in the art. Clones carrying the replacement will be inviable if the gene is essential. However, the replacement may also be performed simultaneously with clones carrying the homologous *M. tuberculosis* or *leprae* gene either on an autonomously replicating plasmid or integrated elsewhere in the genome. If the *M. tuberculosis* or *leprae* gene complements the function of the homologous *M. bovis* or *M. smegmatis* gene, then the resulting replacement clones will be viable.

Resulting clones carrying specific *M. tuberculosis* or *leprae* genes as functional replacements for the homologous *M. bovis* or *smegmatis* genes are useful in in vivo screens for new therapeutic agents. Specifically, synthetic or naturally occurring compounds may be applied to cultures of these functional replacement clones and simultaneously to cultures of unmodified *M. bovis* or *smegmatis*. Compounds which inhibit measurable properties such as the growth or viability of the functional replacement clones significantly more effectively than they inhibit the unmodified control clones may be useful therapeutic agents for specific treatment of *M. tuberculosis* or *leprae* infections in man.

Expressed Genes in Vaccines

The peptide materials of the present invention have utility for the development of antibodies and vaccines.

The availability of nucleotide sequences derived from *Mycobacterium tuberculosis* and/or *leprae* (including segments and modifications of the sequence), permits the construction of expression vectors encoding antigenically active regions of a peptide.

Such expression vectors may be introduced into mycobacteria such as *M. bovis*-BCG to provide stable production of the desired peptide by the recombinant mycobacteria cells. See, for example, details of the expression method provided in published PCT applications WO 88/06626, WO 90/00594, and WO 92/01796. In this manner, the excellent adjuvant properties of the mycobacteria are used to full advantage for the production of *M. tuberculosis* or *M. leprae* vaccines. Alternatively, the peptides may be produced by recombinant means in a variety of host cells including, but not limited to, *E. coli* and subsequently purified for use in vaccines and diagnostic tests.

Fragments encoding the desired peptides are derived from the clones using conventional restriction digestion or by synthetic methods, and are ligated into vectors which may, for example, contain portions of fusion sequences such as beta galactosidase or superoxide dismutase (SOD), preferably SOD. Methods and vectors which are useful for the production of polypeptides which contain fusion sequences of SOD are described in European Patent Office Publication number 0196056, published Oct. 1, 1986.

Any desired portion of the Seq. ID No. 1 or Seq. ID Nos. 23–26 and 120–140 containing an open reading frame, can be obtained as a recombinant peptide, such as a mature or fusion protein; alternatively, a peptide encoded in an open reading frame can be provided by chemical synthesis.

The DNA encoding the desired peptide, whether in fused or mature form, and whether or not containing a signal sequence to permit secretion, may be ligated into expression vectors suitable for any convenient host. Both eukaryotic and prokaryotic host systems are presently used in forming recombinant peptides. The peptide is then isolated from lysed cells or from the culture medium and purified to the extent needed for its intended use. Purification may be by techniques known in the art, for example, differential extraction, salt fractionation, chromatography on ion exchange resins, affinity chromatography, centrifugation, and the like. See, for example, *Methods in Enzymology*, supra, for a variety of methods for purifying proteins. Such peptides can be used as diagnostics, or those which give rise to neutralizing antibodies may be formulated into vaccines. Antibodies raised against these peptides can also be used as diagnostics, or for passive immunotherapy or for isolating and identifying *Mycobacterium tuberculosis* or *leprae*.

An antigenic region of a peptide is generally relatively small—typically 8 to 10 amino acids or less in length. Fragments of as few as 5 amino acids may characterize an antigenic region. Accordingly, DNAs encoding short segments of *Mycobacterium tuberculosis* or *leprae* peptides can be expressed recombinantly either as fusion proteins, or as isolated peptides. In addition, short amino acid sequences can be conveniently obtained by chemical synthesis. In instances wherein the synthesized peptide is correctly configured so as to provide the correct epitope, but is too small to be immunogenic, the peptide may be linked to a suitable carrier.

A number of techniques for obtaining such linkage are known in the art, including the formation of disulfide linkages using N-succinimidyl-3-(2-pyridylthio)propionate (SPDP) and succinimidyl 4-(N-maleimido-methyl) cyclohexane-1-carboxylate (SMCC) obtained from Pierce Company, Rockford, Ill., (if the peptide lacks a sulfhydryl group, this can be provided by addition of a cysteine residue). These reagents create a disulfide linkage between themselves and peptide cysteine residues on one protein and an amide linkage through the epsilon-amino on a lysine, or other free amino group in the other. A variety of such disulfide/amide-forming agents are known. See, for example, *Immun Rev* (1982) 62:185. Other bifunctional coupling agents form a thioether rather than a disulfide linkage. Many of these thio-ether-forming agents are commercially available and include reactive esters of 6-maleimidocaprioc acid, 2-bromoacetic acid, 2-iodoacetic acid, 4-N-maleimido-methyl)cyclohexane-1-carboxylic acid, and the like. The carboxyl groups can be activated by combining them with succinimide or 1-hydroxyl-2 nitro-4-sulfonic acid, sodium salt. Additional methods of coupling antigens employ the rotavirus "binding peptide" system described in EPO Pub. No. 259,149, the disclosure of which is incorporated herein by reference. The foregoing list is not meant to be exhaustive, and modifications of the named compounds can clearly be used.

Any carrier may be used which does not itself induce the production of antibodies harmful to the host. Suitable carriers are typically large, slowly metabolized macromolecules such as proteins; polysaccharides, such as latex functionalized sepharose, agarose, cellulose, cellulose beads and the like; polymeric amino acids, such as polyglutamic acid, polylysine, and the like; amino acid copolymers; and inactive virus particles. Especially useful protein substrates are serum albumins, keyhole limpet hemocyanin, immunoglobulin molecules, thyroglobulin, ovalbumin, tetanus toxoid, and other proteins well known to those skilled in the art.

Peptides comprising *Mycobacterium tuberculosis* or *leprae* amino acid sequences encoding at least one epitope are useful immunological reagents. For example, peptides comprising such truncated sequences can be used as reagents in an immunoassay. These peptides also are candidate subunit antigens in compositions for antiserum production or vaccines. While the truncated sequences can be produced by various known treatments of native *Mycobacterium tuberculosis* or *leprae* protein, it is generally preferred to make synthetic or recombinant peptides. Peptides comprising these truncated sequences can be made up entirely of *Mycobacterium tuberculosis* or *leprae* sequences (one or more epitopes, either contiguous or noncontiguous), or *Mycobacterium tuberculosis* or *leprae* sequences and heterologous sequences in a fusion protein. Useful heterologous sequences include sequences that provide for secretion from a recombinant host, enhance the immunological reactivity of the epitope(s), or facilitate the coupling of the polypeptide to an immunoassay support or a vaccine carrier. See, E.G., EPO Pub. No. 116,201; U.S. Pat. No. 4,722,840; EPO Pub. No. 259,149; U.S. Pat. No. 4,629,783.

The size of peptides comprising the truncated sequences can vary widely, the minimum size being a sequence of sufficient size to provide an epitope, while the maximum size is not critical. For convenience, the maximum size usually is not substantially greater than that required to provide the desired epitope and function(s) of the heterologous sequence, if any. Typically, the truncated amino acid sequence will range from about 5 to about 100 amino acids in length. More typically, however, the sequence will be a maximum of about 50 amino acids in length, preferably a maximum of about 30 amino acids. It is usually desirable to select sequences of at least about 10, 12 or 15 amino acids, up to a maximum of about 20 or 25 amino acids.

*Mycobacterium tuberculosis* or *leprae* amino acid sequences comprising epitopes can be identified in a number of ways. For example, the entire protein sequence corresponding to each open reading frame is screened by preparing a series of short peptides that together span the entire protein sequence of such open reading frame. By starting with, for example, peptides of approximately 100 amino acids, it would be routine to test each peptide for the presence of epitope(s) showing a desired reactivity, and then testing progressively smaller and overlapping fragments from an identified peptides of 100 amino acids to map the epitope of interest. Screening such peptides in an immunoassay is within the skill of the art. It is also known to carry out a computer analysis of a protein sequence to identify potential epitopes, and then prepare peptides comprising the identified regions for screening.

The immunogenicity of the epitopes of *Mycobacterium tuberculosis* and/or *leprae* may also be enhanced by preparing them in mammalian or yeast systems fused with or assembled with particle-forming proteins. Constructs wherein the *Mycobacterium tuberculosis* and/or *leprae* epitope is linked directly to the particle-forming protein coding sequences produce hybrids which are immunogenic with respect to the *Mycobacterium tuberculosis* and/or *leprae* epitope.

Vaccines

Vaccines may be prepared from one or more immunogenic peptides derived from *Mycobacterium tuberculosis* or *leprae*. The observed homology between *Mycobacterium tuberculosis* and/or *leprae* with other bacteria provides information concerning the peptides which are likely to be most effective as vaccines, as well as the regions of the genome in which they are encoded. Multivalent vaccines against *Mycobacterium tuberculosis* or *leprae* may be comprised of one or more epitopes from one or more proteins.

The preparation of vaccines which contain an immunogenic peptide as an active ingredient, is known to one skilled in the art. Typically, such vaccines are prepared as injectables, either as liquid solutions or suspensions; solid forms suitable for solution in, or suspension in, liquid prior to injection may also be prepared. The preparation may also be emulsified, or the protein encapsulated in liposomes. The active immunogenic ingredients are often mixed with excipients which are pharmaceutically acceptable and compatible with the active ingredient. Suitable excipients are, for example, water, saline, dextrose, glycerol, ethanol, or the like and combinations thereof. In addition, if desired, the vaccine may contain minor amounts of auxiliary substances such as wetting or emulsifying agents, pH buffering agents, and/or adjuvants which enhance the effectiveness of the vaccine. Examples of adjuvants which may be effective include but are not limited to: aluminum hydroxide, N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1-2-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/Tween 80 emulsion. The effectiveness of an adjuvant may be determined by measuring the amount of antibodies directed against an immunogenic peptide containing an HCV antigenic sequence resulting from administration of this peptide in vaccines which are also comprised of the various adjuvants.

The vaccines are conventionally administered parenterally, by injection, for example, either subcutaneously or intramuscularly. Additional formulations which are suitable for other modes of administration include suppositories and, in some cases, oral formulations. For suppositories, traditional binders and carriers may include, for example, polyalkylene glycols or triglycerides; such suppositories may be formed from mixtures containing the active ingredient in the range of 0/5% to 10%, preferably 1%–2%. Oral formulations include such normally employed excipients as, for example, pharmaceutical grades of mannitol, lactose, starch, magnesium stearate, sodium saccharine, cellulose, magnesium carbonate, and the like.

Kits

The nucleic acid, peptides and antibodies of the present invention can be combined with other reagents and articles to form kits. Kits for diagnostic purposes typically comprise the nucleic acid, peptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose.

Embodiments of the present invention are further described with respect to the sequence listings which follow.

SEQUENCE LISTING (411 sequences)

SEQ ID NO: 1 - DNA (genomic), 32155 bp, MYCOBACTERIUM TUBERCULOSIS; double-stranded, circular
  hypothetical: NO
  anti-sense: NO
gatctccgcgctgcgcgcgcaccttagccgggtttgagtcgaggctggcttgccgccggtacgctagaggcgccgtcgccttgaccgcggccgcgacaagccgacaaatcgagcacgtgaggatcagcgaaactgtggccgacaaatccaaacgccccccgcgattcgatctgaagtccgccgacggcagcttcggccggctcgtccagattggtggcaccaccatcgtcgtcgtttttgccgtcgtcctggtcttctacatcgtgacgtcgcgcgacgacaagaaggacggcgtcgcgggccccggcgatgcagtacgggtgacgtcgagcaagctggtcacccagcccggaaccagcaaccccaaggccgtggtgtccttctacgaggatttcctgtgtccggcgtgcggcatattcgagcgcggtttcgggccaaccgtgtccaagctcgtggacatcggcgctgtcgcggccgattacacgatggtggccattctcgatagcgccagcaatcaacactattcgtcgcgagcggctgctgcggcttattgcgttgccgacgaatcgatcgaggcgttccgccgcttccacgccgccttgttcagcaaggacatccagcctgccgagctcggcaaggatttccccgacaacgcgcggttgatcgaacttgcccgcgaagccggcgtcgtgggcaaggtgcccgactgcatcaacagcggcaagtacatcgaaaaagtcgacgggctggcggcggcggtcaacgtgcacgcgaccccgacggtccgggtcaatggcacagagtacgagtggtcgacgccggcggcgctggtcgccaagatcaaagaaattgtgggtgatgtgccgggcattgactcggccgctgctaccgcgacatcctgacgattgtggtggcagctcgacctgccgagcgatccggcgacccggctgcggtgcgggtgccggtgcctagcgcgtggtgggtgctgatcggcggtgtgatcgggctgttcgcttcgatgacgctcacggtggagaaggtcaggattctgctcgatccgatctatgtgccgtcatgcaatgtcaacccgatagtgtcgtgcggctcggtgatgaccacaccgcaggcgtcgttgctgggctttcccaacccgcttctcggcattgcgggcttcaccgtggtggtggtcaccggggtgctggcggtggcgaaagtgccgttgcccaggtggtattggatcggcctggcggtcgggatcctggttggtgtggcgttcgtgcattggctgatattccagagcctgtaccgtatcggtgccctgtgcccatactgcatggtggtctgggcggtcatcgccacactgctggtggtggtcgcgtccatcgttttcggtccgatgcgggaaaaccggggaagccaggagcgcgtcggggcacggctgctctatcaatggcgatggtcgctggccacgctctggttcacgacagtattcctgctgatcatggtccgcttttgggactattggtcgacgctgatctgagacatccggataagggagccacacgtgttttccaaggtgctcgtcgccaatcgcggggagatcgcgatccgggcctttcgtgccgcctacgaactgggcgtcggaaccgtggccgtttatccgtacgaggaccgcaattcgcagcaccgtctcaaggcggacgagtcttaccagatcggcgacatcggtcacccggtgcatgcatacctgtcggtcgacgagatcgtcgcgacggcccgtcgggcgggtgccgacgctatctaccctggctacgggtttctatcggagaatccggatctggctgcggcatgcgcggcggcgggcatcagcttcgtcggtcccagcgccgaagtgcttgagctggctgggaataagtctcgcgccatcgcggcggcccgcgaagccggcttgcccgtgctgatgtcctcggcgccgtcggcctcggtcgacgaactgctgtcggttgcggccggcatgccgtttccgttgttcgtcaaggcagttgccggtggcgggggccggggtatgcgtcgtgtcggcgatatcgcggcgcttccggaggcgatcgaagccgccagccgggaagccgagtcggcgttcggggacccgacggtctatctcgagcaggcagtgatcaatccacgccacatcgaggtgcagattctggcggacaacctcggcgacgtgatccatctctatgagcgtgactgcagtgtgcagcgtcgccatcagaaggtcatcgagctggcgcccgcgccgcacctggacgccgagttgcgttacaagatgtgcgtcgatgcggtcgccttcgcccgccatatcgggtacagctgcgcgggcaccgtcgagttcctgctggacgagcgaggggagtatgtcttcatcgagatgaatccgcgggttcaggtggagcacacggtgaccgaggagattaccgacgtcgacctggtcgccagccagctgcgcattgccgccggggagacgctcgaacaattgggcctgcggcaggaggacatcgcaccgcatggcgccgcactacagtgccggatcaccaccgaggatccggccaacggcttccggccgacacgggccggatcagcgcgttgcgacccgccggcggtgccggtgtccgcctggacggcagcaccaacctggcgcagaaatcagcccgtacttcgactccatgctggtcaagctgacctgtcgggccgtgacctccctaccgcagtgagccgtgcgcgccgggcgatcgcggagttccggatccgcggggtatcgacgaatattccgttcctgcaagcggtcctggatgacccggacttccgagcgggccgggtcaccacgtccttcattgatgagcggccgcagctgctgaccgcgcgcgcctcggccgaccgcggcaccaagatccttaacttcctggccgatgtcaccgtcaacaacccgtatggctcgcgtccgtcaacgatctacccggacgacaagctgcccgatcttgatctgcgggccgcaccaccggccgggtccaagcagcgactagtcaagttggggccggaaggatttgctcgttggctgcgggagtcggccgcggtcggggtcaccgataccacattccgggatgctcaccagtcgttactggctacccgagtacgcaccagcggactgtcgcgggtggcaccgtatctcgcgcggaccatgccgcagctgttgtccgtggagtgttggggcggtgcgacttacgatgtggcgctgcgctttctcaaggaggatccctgggaacggctggccacactgcgtgcagcaatgcccaatatctgcttgcagatgctattgcggggccgcaataccgtgggctacacgccgtacccggaaatcgtgacgtcggcgtttgtgcaagaagcaacagccaccggtatcgacatctttcgtatcttcgacgcgctcaacaacatcgagtcgatgcgtccggcgatcgacgcagtacgcgaaacaggttctgcgatagcagaagtcgcgatgtgctacacgggcgaccttaccgatccgggtgaacagctgtacacgctggactactacctgaaactggctgagcagatcgtggacgccggcgcccatgtgctggcgatcaaggatatggctggactgttgcgcccgccggccgctcaaaggttggtcagcgccctgcgcagtcgcttcgacctgcccgttcacctgcacacccacgacacaccgggtggccagctcgccagctatgtggccgcttggcacgccggggccgatgccgtcgacggcgccgccgcgccgctggcgggaacgaccagccagcccgcgctgagctcgatcgttgctgccgctgcccacaccgagtacgacaccggcctgtcgctttcggcggtgtgcgccctggagccgtactgggaggcgttacgaaaagtgtatgcgccgttcgagtctgggttgccggggccgacggggcgggtttatcaccacgagattccgggcggccaactgtccaatctgcgccagcaagcaattgctcttggtctgggagatcgattcgaagagatcgaagaggcctacgcgggcgccgaccgagtgttgggcaggctggttaaggtcacgccaacgtccaaggtggtcggcgatctggcgctggcactggtcggcgccggtgtcagtgcagacgaattcgcctccgatccagcgcgatttggcatcccggaatcggtactcggatttctgcggggcgagctgggtgatccgcccggcgggtggcccgaaccgctgcgcactgcggcgctggccggtcgcggggcggccaggcccactgcgcaattggcggcggacgacgagattgccctatcgtcggtcggagccaagcgtcaggccaccctgaacaggctgttatttcccagtccaacaaaggaattcaatgagcaccgggaagcctacggcgacacgtcgcaattgtcggccaaccagttcttctatggtctgcgccaaggtgaagagcatcgggtgaagctggagcgtggggtggagctgttgatcgggctggaggccatttccgaacccgacgaacgcggcatgcgaacggtgatgtgcatcctcaacgggcagctgcggccggtgctagtgcgcgaccgcagcattgccagtgccgttccggccgccgagaaggccgaccgcggcaatcccggacacatcgccgcgccatttgccggagtcgtcacggtcggggtgtgcgtcggcgagcgggtcggcgccggccaaaccatcgccaccatcgaggcgatgaagatggaagccccgatcaccgccccggttgccggcaccgtggagcgggtggcggtgtcggacaccgcagagtggagggcggagacctgttggtggtggtgagctgaccgccccggcgacgatgcagtgggggtaccgcctgcttgcggggacgaagcgatgaggtgggggtaccgcccgcttgcggaggagcggcgcagatgagcaccgccggcgacgatgcagtgggggtaccgcccgcttgcgggggacgaagcgatgaggtgggggtaccgcccgcttgcgagggagagcggcgcacttgacccggatcatcggcggtgtcgccggaggcggcgcattgccgtcccaccacgcggaaccagacctaccaccgatcgggtgcgcgagtcgctattcaacatcgtgactgcgcggcgggatctgaccggtctggcggtgttggacctctatgcgggttccggcgccctggggctggaggcgttgtcgcggggagcggcgtccgtgctgttcgtggagtccgaccagcgcagcgcggccgtcattgcgcgcaacatcgaggccctaggtctctccggtgcgacgctgcgccggggcgcggtggcggccgtcgtggcggccgggaccacgtccccggtggatctggtgttggccgacccgccctacaacgtcgactccgccgacgttgacgccatcctggccgcactgggcaccaacggctggacgcgcgagggaaccgtagcggtggtggagcgtgcgaccacgtgcgcgccgttgacgtggccggagggctggcgccgatggccccagcgtgtttacggcgacacccgtttggaactggccgaacggctttttgccaacgtgtagcgtcatcggtcatgaccgccggcgacgatgcggtgggggccgtgcccgcttgcgggggacgcagcgatgaggaggagcggcgcagatgacgggcgcggtatgcccagggtcatttgacccggtgacgttaggccacgtcgacattttcgaacgcgccgcagcccaattcgacgaggtggtggttgccatcctggtcaaccctgcaaagacgggcatgttcgacctcgacgagcggatcgcgatggtcaaggagtcgacaacgcacctgcccaatctgcgcgtgcaggtcgggcatggcttggtggtcgactttgtcaggtcttgcgggatgaccgcgatcgtgaaggggctgcgcaccggcaccgacttcgaatacgagctgcagatggcgcaaatgaacaaacacattgccggtgtggacacctttttcgtcgcgaccgcgccacggtattcgttcgtgtcgtcctcactggccaaagaagtcgcgatgctgggcggtgacgtgtccgagttgctgcccgaaccggtgaatcgccggctgcgggacaggctcaacaccgaacggacctagctcctttgcgggactaggtccgatcgtgtgaggccttcgccgactagctggggtcaaagcactcgtagaacgtctgggttgcgtagtcgtagcaggtgtaggtgccccactcgggttggtgggtcggggcggcattggcggtgccggtagcggctccgaaggccgccagtccgatcgccgaggctagcagagacatgccggcgagggcgcggatacgggcagtgaacattgggtacctctctgtcgcgttgtggctgaatgttggtttgccggcggtggccgacaagtcaagattgaccgcggccgcttggcgtatccttgcgacgttcttgggaccgacttgcctagcgcgggctcggtggcggacggcgtttccttcgacgaaaggcgcgttgcaccattcgcaccggcccagtgggactggcgtgaacgttcttcgaaagcgatattggatgcgctaggtgcgaaaattgtcctaattcggggccgcgctgagcagacccaccggtcctgtctacactccgctcctttgaccgcacctgccgcaggccaggtcttcggggttcttccacagtgcaaagcgggtgtcccttgagcttgcgtactcgctcatgagctggccgcgccggggcgtttttggcgggccgaccccggccccacgtgggctcgctacgtgacagcgcccacccggacagttcacgttgaccgggtgaggccaaacggcgccgagcgtgcactgggggcgagattcgggccagccgattttccgccctcagttcacgctgggcgacggcgccgaaacggccagtcgacgccgtgaccatcatgggcaccaagaagttgaccgcaacgcgcgcagtcacccatgtcagaagacgatggtctggttgtgatgcacgatgacgcggtcttggcagtgccagagcacggcgcgggaaagcactgcgcgttcgacgtcggcgccgacacgcaccagatcatcgacggtgtgggtgtggtcgacacgaacgacgtcttgttcgatgatgggcccctcgtcgagaacttcggtcacgtagtgggcggtcgcgccgatcagtttgacgccgcgttctcgtgcgcgctggtacggggccgcgccggtgaaggctggaaggaacgaatggtgaatgttgatcagcgggcagccgatcgcctccaagaaccccgggctgagtatctgcatgtagcgtgccagcactactaaatccacattgccgcttagcaactgaagctgacgctgttcggcttccgtacgagtgtcgcgagtggcgggaatatgtatgaatggcacaccgaacgggcgtacgtgcgcggccaggtcaggatgattggcaatcaccatgacaaccgacatttctagctcgccgcgacggttgcgccacaacaagtccagcaagcagtggtcctctgtcgatgccatgattgcgacccgcttaggcttggctgcttcggcaaatcggtagtcgatgccgaacttgtccgccacagtgctgccgaagtcgcgctgcagttcgtcgacggcggccgtgagaccgggcaggtgaaagattgcgcgctgcaagaacgttccgccctccggcgcggtggagtgctggtccagagaaatgatgttggcgccggcccgggccaggaaggtgctcaccgcggcgatgattccagggcggtcgtggcaccgaagcagtaaccggccaatatcggccggcggcggtggaccgccaggcggtggcggataatccggctcgttcggcgttgcgtgcgcggtcatgctccctttgcccatgggtggaatacccgcaggccaggataccgccgccggtggccttttcggcgccgactgatcggcgtggtggcgctagtggccgaggtgatcgtcgtggcggtcatggtggtcatgcggggcatccggtgagccgcccatcatgcgtagcatcgggagaccgcccgatgtgatgaatcggaccaccaaggccgccgcgatcaccagaaagatgacgttgagccaggtggtgtagttccacgatatttctgcggtcatgaccgtagcgctgcgctggctcgggatgagattcgttgtaccgaagagaagttcgatgagatagccagcgacgaccatcgatgcgtagaaggtgccgagcagcaccagcatcatcctggcgccatagtatttacggtagatattcaggatcggcagtatcagtaggtcggcgaagatgaacgcgatgaccccgccgaagctgatgcctccgttccacagcaccgcggcaagtggcacgttgccgatcgagcaaacaaacgaaacgatggccacgatgggtcctatgatcggaccccagaccgccgaccaggccggatgattggctaaaaagaagctctgccagaacgattcgggtacccatgccgcgatagcaccggcgatcagcagcccgagaatgaggtcgcgcaggatcgccaaccactccatcacgaacacatgggcgatggaggtaaatcccggtggggaaaggagtcgtcgccaaaatgagccttcccgcttgatggacatgtccatggcggcatggccttccatcgagcctgcgagtccccgttcggcctgttcccgggcggcgtcgatgagccgggcgccgacgaacaaccggaacaacacggccaggacaaggatcattattggaccgccaacgaactcggcggcggtgaactgccagcccatcagcagggccaggatgatgcccaactccaccacgaggttggtggaaccgatctcgaacgccatagcggcagtgaagttggcccctttgcggaatagtgaccgagccaaagccaccgcggcatacgagcacgacgacgaggccgcgcccaggccggtggcgattaccagggtgcgcggccgatcgtcgccgagcagcgtgacgatcgtggagcggcgcaccacggcttgaaccaccgccgacagcgcgaagcccaggatcagcgcccacaggatttcccaggtcatcgacgcggtcagcgccagtgcgtgcccgatcgctcccagcactgctgccgtcactcggtcctccactttggttgaggtcacgctctgccctccaccatataccacccgggggtatagtcaccggggtgggcaacgaccgcgcagtggtgccgctaaacgtatcgccgccccactcttgccgaggttttccccgagtgcgcgtgtcgtgcgtgtacgctacggcgtcgaggtggggcgggccaccggttgctagcgaggtgagaggggacgcggccatcagcacgacaccggacgccgcacctgggcttgccgcacgcaggcgccggatccttttcgtcgcggaagcagtgaccctggctcacgtcgtccggccattcgcgcttgcgcagtcgctggaccctagtcgttatgaagtgcacttcgcctgcgacccgcgctacaaccagcttctaggtccgctccctttccgtcaccatgcgattcacaccatccccagcgagcggtttttcggcaatctgactcagggtcgtttctatgccatgcggacgctgcggaagtacgttgaggcggacctgcgggtcctggatgagatcgcgccggacctcgtcgtcggtgaccttcgcatttcactgtcggtcagcgcccgactggccggcattccttacatcgcgatcgcgaatgcctactggagtccgtacgcgcagcggcgttttccgctgcccgacgtgatatggacccgcttgttcggcgtcaggttggtcaagctcctctaccgcctggaacgccctttgctcttcgccctgcagtgcatgccgctcaactgggtccgccgcaggcacgggctgtcgagtctggggtggaacctgtgccgcattttcaccgacggggaccacaccctgtatgctgacgtgcccgagctgatgcccacctacgacttgccggccaaccacgagtaccttggcccggtcctgtggtcgcccgccgggaagccgccgacatggtgggattcgctgccaaccgaccggccgatcgtgtacgcaaccctgggcacgtccggcgggagaaatctgttgcaactggtgttgaacgcgttggctgagttgccggtgacggtgatcgcggccaccgcggccgcagtgacctgaagaccgtgccggccaacgccttcgtggcggactacctgccgggtgaggccgctgcggctcgctcggccgtggtggtctgcaatggcgggagtttgacgacccagcaggccttggtggccggggtgccggtgatcggggtcgcgggcaatctcgatcagcacttgaatatggaggccgttgagcgggccggggcgggcgtgctgctgcgaactgagcggctgaagagtcagcgggtggcaggggccgtgatgcaggtgatcagtcggtccgagtacccgacaagccgccgcgcgactcgccgatgccttcggacgagaccgcgttggattcccgcagcatgtggagaatgctctgcgcctcatgccggagaaccggccccggacatggttggccagctagttacttcgacctgaaaaagtgacggcgactaagtgagtcgtttgtgggcgaatgccgccggactgttggtggggcagagcttcgtgctctgggagccgggtcatgctgcgaggctgctgatcttgatgaggttgtgggtgaggatgccgtgcctggtccagatccgggttccttcggtgccgtcgatgcaggagcggttccaaccgtagtttcgtttgagggtgctgatgcggccttcgctgccggtgcgccacttgactgttcgtcggaacgatggccgttgttcttcggcgcgccgggcctgggagggtctgcctttcgcggtatcgcgaccgtacgtacaccgaggtcgtgcaggtcatcttcgacgcgtttctcgccgtagccgcggtcggcggtgacggtgccgggcgggcgtccggcgcgtgtggtgatccgttcgaccgcgggcgctagctgcggcgcgtcatgcggattgccgtgctccacggtgtgatccaggacgatgccatcgtcgttgtcgacgatctggggcttgtgcccgaactcgaccggccccggccttctgccgtggggaggaacgccacggcggtagtgtcactacccgtggttgcgctgtcaccgcgagcaggacaagctggctacctttggcagtccataacccgcggtttgagggtaaccccaatctgttgctaccatccgccgtgcggtggcggtgtccagaagatgctcagccgcaagctgggtcgcgtatgcccggcaccgagccccaaggatgcggcgcgcggagctcacaacgtgggcgcgaacgcggtctaacgaattgccgcagccatgtattgagtccgcttcgacctcatcagttctcttaaagaggcttgctaaatgaccaacattcgactgactacggtttcgcagtgaggagatgatggaatggggctagtgtggcgcagtcggactagtcttgtagggcaactgatcggactagtcaggttagtggcgagttttgcggcccagttattctaccggccgagcgacgcagtggcggaagaataccacaagtggtactacggcaacttagtgtggacgaagaccacttatatggggatcaattgctggaaatccgtcagcgatatgtggaattaccaggagatcctgagcgagttgcaaccatccctcgtcatcgagttcggcacccgctacggcggctcggcggtgtattttgccaacatcatgaggcagatcggccagccattcaaggtacttaccgtggacaactcacacaaagccctcgatccaagagcccggcgcgaaccagatgttttgttcgttgaatcgtcatccaccgacccggcgattgccgaacaaattcaacgcctcaaaaacgaataccctggcaagatcttcgccatcttagatagcgaccactcgatgaatcatgtgctggccgagatgaaattactacggccgctactctccgccggtgactacctagtagtcgaggattccaacatcaacggccacccagtcctgcccgggtttgggcctggaccctatgaagcgatcgaggcatatgaggatgaatttccaaacgattacaagcatgatgcggagcgggagaacaaattcggctggacttccgcgcccaacggatttctgatccgcaactagcggtcggtgtgagaaatagctcgacgcattgcattttgggggattgcatttttgggaggttgcctgcgggtacgggctgcctcgagattagggggcgagtatggaggaaacaagcgtcgccggcgacccgggaccggacgctgggacgagcacggcgcccaacgccgcaccggagcctgtcgctcgcaggcaacggatcctgtttgtaggggaggccgcgaccctggcccacgtcgtccggccgttcgtgttggcgcggtcgctggacccgagtcgttatgaggtccactttgcctgcgacccgcggttcaataagcttttgggcccgctcccgttcccacatcacccgattcacaccgtccccagcgaggaggttctccttaaaatcgctcagggccgcctcttctacaacacgcggacgttgcgcaaatacatcgcggctgacaggaagatcctgaacgagatcgcaccggacgtagtcgtcggtgacaaccgtctttcgctctcggtcagcgcccgactagccggcattccgtacatcgccatcgcgaacgcctactggagtcctcaggcccgccgtcggtttccgctgccagacgtgccgtggacccgcttcttcggggtcaggccggtcagcatcctgtaccgcctgtaccgtccgttgatctttgccctctattgtctcccgctcaactggctccgccggaagcacgggctgtcgagtctgggctgggatttgtgccgcattttcaccgacggtgactacaccctgtatgccgacgtacccgagctggtgccgacatacaacctgccggccaaccatcgatatctcggacccgtcctgtggtcgcccgacgtaaaaccgccgacttggtggcactcgctgccgacagaccggccgattatttatgcgaccctcggcagttccggcggaaagaacctgttgcaggtggttttgaacgccctggccgatttacccgtcacggtgatcgcggccaccgctggccggaaccacctgaagaacgtgccggccaacgccttcgtcgcggactacctgccgggcgaagcggctgcagcgcgtctcgccgtggtgctctgcaacggcggcagcccgacgacgcagcaggcgttggcggccggggtgccggtgatcgggctccccagcaacatggaccagcacttgaacatggaggcccttgagcgggccggcgccggcgttctcctgcgaaccgagcggctcaacactgaaggcgtggcggcagccgtaaagcaggtgctcagtggggccgagttccgacaagccgcccggcgcttgccgaagccttcggaccagactttgccggattcccgcagcacatcgaaagtgcgctgcggctcgtctgctaaagggtgcccacgatatcgccggctagccaacggatgtccggtcgagcacctgattcgggagcgtgtcgcagttcaaaacgctgaagtaccgcaacgactctcctgaacggttcgattcgatcgaacacgcccgcacctggccaggccacatgggcgcggccatggccaacgcctactcggccaacccgaatccattcggcgtctcaccgcaacccccgaaaccggcgaccgcggcatggatcaacccgcccaccccagatccgaaatagcgtccacataatgagacactggcgcaaagagcttgacaggcgccgcaccacgcaagctgttagacgtgtcggtcttgcaagaggcgggttggccacccaagatcacgccgcccaagggcatcgagtcaacgttgcggtggtatcgcgctaacgtcggcgccgccaagaaatgacggtgcgcattaccatggccctgctgatcacctttggccacctgcgcaccagaactatgaccagccttatgccgagtctcgtggacatcggcagccgcttcaaaaactccttgtcgacgatcgtattgctgagcccgccgaattcgttgtagcttgcaacgaccacgtgcatgtagcgggtgacgagcgctgggttggaaaagcagcgaatattgaagtcccagtcggccaggacccggtagcggaggttgtagggaccgatggtgccgaagagtccgcggcggtagaagatcgcctgatggcagatgttgcgcttgaacaacagacggtcgaggtcgaaggcgccaccccagcggaaattggttgagcgcatgatcacgtcgccatataccagatcgctgggctcgtgttcgccaatgaaggcggccacccgcgccagggtgtcagcctcgtacaggctgtcgtccgcgcccagaaagagcaaccacgttccggtggccaggtccacgccgcggttcatggcgtcgtagacgccctggtcggtgtcgcgatgaatgatcaaccgctcgccgaggttgggggcgaaaatgttggcgatgtcgagggtttcgtccgtcgagccgccgtcgaccagtaccagctcgaagtcaccgcaggtctgacgggcgatgctgtcgaggcaggcaggcaataccgcagccacgttcaaggtggggatgatgatcgaaaacattggtgcggccatggcgactttctttgtgttagctgcggtcaagccggcgtatcgtttcgtctgcaccatcttcgacccaggcgatctgcgcggacctctggtgcccggtctggtgccgggctcgcgaagcgattccaatcaatcgtcctcgcggaaaaagatgccgtcggcctgcaacattcgaccattatttgcatcaatgaaacaaggcagcaatcccgtcaacgtgaagcccaaggaatacacgagatcgagggcttcaggaatgagcatgccaccttcgtacaacggcaggaaggacagttcgagttgcatgccgacgcaatggtcatctatggttgatttgcccccggcgagcacctgcttttcaaagccttgaacgtcgaccttgagaaaagcgacaccgttcatgcctagaaattctggcgccacggaatcaagtcgatgtatggacgcctcttgggtaccgacatagtttgccgggggaaaagcgttctgatgacttttcagcatgggcaagacggaactgctctgaccggcgtttcctgcgatattgatcgtaaccgttccatcagaatcgcccaacgcatgctgccggcaatcccaaagtggatccgttgacgctttgctttccaagatcgtaaacggtccggatagcggttcgaacgagacaatgcggcccttatatgctgctcggcggaggccggcggcgtattgtcctgagttggcgccgacatcgaaaacgacatctacccgacgcgatttgagttgcttcacaaactggtgcttcaggtctcgctcagaatagcggcgcgaaacctcgaaggcggcgctacgcgcgatgaaacgagcgagtttcaacgatttcactgtgcaacactaacacgctaaatactccgccccgggggatagtttgggtcgcgcaacattgcagtgggtctgcggacccgaggttcggtcacaacgccaggcgctgctgacgattggacctggtgcagttccaagatgtgcgcctgatgcgggtggtagtgtgcagacggcttgggccggcgaagggccagcggcgttggcgcctttggatctgggcaccactggttgtttcgagaacctcggagctcaacggccgacctaccggatgcgggcgatccggatgttagagtgcgccatgccaaaccgcctcgttcgagcctgcaacgctggcggccgtttggcttgcccccccatcggtggcggctggccccctggtattggcgcggcctccaggtcacccttgagccggggtcggccatcgcgtggatcgttcggttgaccggcgggttcgaggagaccgagatcgacatcgcggcggcgctctattccgcgctctacccagaccgctgcatcctcgacgtcggagccaacgtcggcatacacagcctggcctgggcgaggttagccccggtggtagccctggagccggcgccgggcacccattcgcggttggaggccaacgtggccgccaacggcctgcaagaccgcatccgcacgctgcggacggccgccggggacgcggtcggcgaggtcgactttttcgtggcggccgacagcgccttcagttcgctaaacgacacgggacgaattcggattcgcgagcggacacgggtgccgtgtaccacgctggacgcgctcgccgccgagctgcccctcccggtgggtctgctgaagatcgacgttgagggcctcgagcgcgcggtcatcgcgggcgccgcggagcttctgcggcgcgatcgcccggtcctgctggtggagatctacgggggcgccgcctctaatccggaccggaacggaccattgcggacatccgcgcgtacggttacgaaccgttcgtctacgccgacgatgcggggctgcagccctaccaacggcaccgcgacgaccggtactgctacttctttattccgagccggaagggatagctggcgccggctgccgctctctacctcgagtgcttgccccgggcgtttgcgctgctgggtggcggtggcgtccagggccaagcgggcgtgggctcgaggaggtcgatacgctggggccgcagacgtgtcagcagctcgatagccatcggcgagcgtttctcctcggcgaggtgcgctatcctcgcctgatgcgactccccggcatgttgcgcccgactgcggaacggcattttcacagcatcttttaccttcggcacaacgcccgccgtcaggagcacctggccacgctggggctcgacctcggcaacaagagcgtgctggaggttggtgccgggatcggcgatcacacgcagttcttcctcgaccgcgggtgcaaggtgctctgcaccgagccccggggggagaatctggatgtcattcgccaacgcttcgggtccaatcccaatgtcacagtcgaccacctagatctcgacggcgatctcccagcagaagcgcaccaatacgacgtggtgtactgctatggagtgctctaccacctctcccgtcctgccgaggcgctggcgtggatgtgtgaccgcgcagtggaccttctgctgctggagacatgcgtgagctattccggcgaagacgagccttttctggttagtgagagggcttcctcgccgagccaggcgataaccggcacggggtgtcggccttcgcgcgtgtgggtgatgaaccgactgagggagaagatgccgcacgtatatgtgaccgctacgcagccccggcaccggcagtttccactggattggcgggcgaacggaccgatagcttccacaggtttggctcgtgcggtgtttgtcgcttcgcgggctccgctgaacctgccgaccctggtcgaggagcttccgatggtgcagcgccggtgctgaagcccacatgtgaacgtgggttgtcgtcaggagtttgattctcggcggcaaaggcccagatctgggagaacaggattgggctaatgtgcccatggcatagctaatcttgctggcggccggggtggagatgttagctcagcctggtcgttcccatgaccacgccggcgcccgggaggcgcgccaacaacgcatcgcccatcgccgctgcgggagtgagcaccccccgcagctcggcgagccgatcgcgatcgagcgccagcgccagaccactctgcgcgagcaacaccgcggtcgacttgtacgcgtcgacgttgtgcgcgaaagtcgccctgtagcgggcaccggtcgtcgtggtggtgtacgtctcgaaggtgtaatggccccgctcttgcgttttccggctcggaccggtgcctggctttggcgtgacgcgctccactaatcgtcggggtagtcggtcgaaatacttattccccaacccgatggtgcccgccacagtgccggtgacggctgcggcgagaatcggcgccgccatcgactttcccagactcattgtttccgagtagcggaaccgccggccataagcccactcctgtaatgcgttgctacgccgaacgattcgagtgttaaacggagcctgcacaaacccgccggtccagaagccggcaagttcgggcgccagatcacgtcctggacgccgaagaaaatccggctgcgcaccaagttcgggttcggcgccccggtccgtggtcagcgtgtacgggtcggtgacgagccgacgggcctcggggtcgctggatgccgtgcgcattgcttcggaatacgttgctaccgagccgccggagacccagcgttgcgagaatgaacgcagcacgaaggtcggtgtcacacagttcaccggtgccgtcctcgacggaccgacggtacagctgatacacgttcaaatccgaagggatcgaatcgaatccgcacgccaggattatccgggcgcccgtgtcggcggcttgtttgtggtacagatcgatgctgtttcggcagaacatcaactcgccagtcaggtcggcatagtcggttccggccttcgcgcaggccgccaccagcggcaggccgtaacgcgtgtaggggccgaccgtggtcagcaccacctgggcccgcgcggccatcgcctcgagcgtcaagggttgggatgcgtcggcgaggatcagcggccagtccgctgcgttcgggcccaacatcatccgcacgccccgcagccgttcgcttgaccgaccggccaatgcgatccgtgctgttgacccgctgtgagcgaggtgttcggcggtcagcttgccggagaagccggtggcgccatatagaacgatgtcgaactcgcgctcagctgggctcatccgggcgacattacccgaaactggctcagtccttggtgaagcagtacatccggtacgagagttccccgccttccaggtagcgggacagctgcgtgccctgcacaccgatgaattcgcggcccgcgaaacgcaggaaggccggcaaatggcggtcgaccaggtcccgtgacttctgtgaattgtttccgatgccgcgcagcacttcggcgttgatttgccgctgcgacagttgccgcagcggggtagcagcgaggtcggcctcccatgcggcgatctcattgttggggcgcaggtcggcgtatgggaagtaccctcctgggcgcagcacgcgaaccacctcggcgaggaaacgccgaaagtgcgggtaacagtgcgaggcttcgacattgagcacaacatcgaaggattcgtcgtcgaagggcaggttttcggcgtcacctcgcacgaagtccaaaccaggcagccggtgtcgtttcttgcacaacttgattcccgcctggttcaagtccaggccggtgtaggaggccgggtgcaacgtgcgtgtgaggtaagaggctccgccgccgtgtccgcaactgacctccagcacctgcttgccgcccagatcgacctgggtcgcggtgcggtggtacaggttgatgtgggctcggttgggctcgtcggatgcctccagtggcaggtccatcggcggatcttcctcataggcccagttgatgaacacgatttcgtcgttaccgagtccgcgcgtcatcaacgggtaccagtaccgccaaactctcttgtaggtcgaggtactgcccgcgcgggcgaggaggctgtgggttcgactgaaggccatgggcaaggagtatggcagacagtatgtacgagcgatgcgtcagaagagaagttggcgcaacaccgagcccgcggtcgatgccatgacatccgaccccggtgttgctcaacgcgcgaccgcgcgacatgactcgctgaggtagcgttcctagccatgacgttggtcaacagcgtagtagacaaggggtaggcgtgggcggacttcgtttcggttttgttgatgccctccgtgcactcgcggttgccgccgaccctgccggcacggtctagcatgcggccgccaccgtgatgggcgccgactcgtattggtcggcgaccatctgaatgcgctggtgccgcgctcgattgcgacttccgaatatctcggaattgcggcgaaattcgtgcccaagatcgatgccaattacgaaccgtggacgatgcttggaaacctcgccttcgggttgcccagccgtctgcgactgggcgtgtgcgtgaccgatgcaggtcggcgcaatccagcggtcacagcccaggctgccgcgactttgcacttgcttacccgaggccgagccatattgggtatcggtgtcggggaacgtgaaggcaacgagccctacggtgtggagtggaccaaaccggtggcgcggttcgaagaagccctggccaccattcgcgcgttgtggaattcaaacggggagcttatctcacgtgaatcgccatactttccgttacataacgccttgttcgaccttccgccataccgtgggaaatggcccgaaatctgggtcgcgggcccacggatgttacgggccaccggacgttacgccgatgcctggattcccattgttgtggttcgtcccagcgactacagtcgcgcactcgaagcggtgcgcagcgcggcgtccgatgccggacgcgacccaatgtcgattactccggcggcggtgcgcggcatcatcactggacggaatcgcgacgacgtggaagaggcgctggaatctgtcgttgtgaagatgaccgcgctcggggtacctggggaagcctgggcgcgtcacggcgtcgagcatccaatgggagccgacttctccggtgtgcaggacatcatcccgcaaaccatggacaaacagacggttttgtcctacgcggccaaggtcccggctgcgcttatgaaagaagtcgtcttcagtggaacccctgacgaagtcatcgatcaagtagcggaatggcgagatcacgggctgcgctacgttgtgctgatcaacggcagtttggttaaccccagcctgcgcaagacggtgacggctgtcctgccgcacgccaaggttttgcgcgggctcaagaagctatgatttgcgccactctcgcgaagatggggtaagccggcccagcggcggcgtgccaatcgcggcgtgcggcaggcgatttcggcgtgtcgagcttggaactcgatgtgaatttcccagagtgcccacaggtcagccgtgcgcacgttcagctgacttgaggtcaggccattgatcagcggttactcggttcggcctcgccgcaacgggcttgccgtgattcgtgttggtgggggcacggtgtaccggcgggatcagtcggttgcggtctctgaactgtgacctgtggggtctgacagcgctctgcgggtgccacccgtcgcgaccggatcgaacgaatcgcacggcgctggcgaattcgctccggcacgatcagcaggtcgacatcgaagacggtgctcattaggcttagcgaagccagcccgacggtgtgtttcgcgaatggggctgcagccagcgctgacgccgcggctgacgattccgtcaatcccattaggccctcgggtgtggcccgtacctgctatggtcgtgagaccttaacgaatcgcgtcgcgagcccgggcaaggtacagacgctatgcgccgactcggattcgtatgaaagcggcagcgcagccgtctgctctctgccgtccatagctgaaggaagaccatgaaaaccaactcgtcatttcatgccgcgggcgaggtggcgacacaaccggcatggggcaccggtgagcaagcggcacaaccgctgaacgggagcacatcgcgattcgctatgagcgagtcgtcgctcgctgatctcctacagaaggcggcgagccagtaccccaatcgcgcggcgtacaagttcattgactatgacacggatccggctggcttcaccgaaaccgtgacgtggtggcaagtccaccggcgagcgatgatcgtggcagaggagctctggatatacgcgtcaagcggtgatcgggtcgcgatattggccccgcagggccttgaatacatcatcgcctttatgggtgtgctgcaggctggtctcattgcggttcctcttccggtgccacaattcggcattcacgacgaacgaatatcttcggcattacgagactctgcgccgtccattattcttacgacctcgtcggttattgacgaggtcacgacatatgcgccacatgcgtgcgccgcacagggccagtccgcgcccatcgtcgtggctgtggacgctctggacttgagctcatccagagcgctcgatccgactcggttcgagcgtccgagcacagcatatctacagtacacatccggttcgacccgcgcgccggccggtgttgtcctctcgcacaagaatgtcatcaccaactgcgtacagctaatgtccgattacatcggggattcggaaaaggttccgtcaactcccgtatcgtggctgccgttctatcacgacatggggttgatgctgggcatcattctcccgatgatcaatcaagacaccgcggtgttgatgagtcccatggcattcttgcagcggccggcccgttggatgcaattattagccaaacaccgcgcacagatttccagcgcaccgaatttcggtttcgaattggcggtacgcagaacatccgacgacgatatggctggacttgacctcgggcatgtgcggacgatcgtcaccggcgccgaacgagtaaacgtcgcgacgctgcggcgcttcaccgagcggttcgccccgttcaacctcagcggacggcaatccggccgtcatatgggctcgcggaggcgacggtgtacgtggcgaccgccggaccgggacgcgcgccgaagagtgtttgctttgactaccagcagctgtcggtcggtcaggcgaagcgtgccgagaacggcagcgagggagccaacctggtgagttatggagctccccgggcgtcaaccgtgcggatcgtcgaccccgaaaccaggatggagaatcccgcggggacggttggcgaaatctgggtgcagggagacaacgtcggcttgggctactggcgcaacccgcagcagacggaggcgacgttccgcgcgcggctcgtcactccctcgcccgggacttcggaaggtccgtggctgcggaccggagacctcggcgtcattttcgagggcgaactgttcatcacgggtcgcatcaaggagctgttggtggtggatggggccaaccactatccggaagacatcgaggcgacgatccaggaaatcaccggcggccgggttgtggcgattgcggtgcccgatgaccgtactgaaaagctggtaaccattatcgaactcatgaagcggggtcgcacagatgaggaggaaaagaatcgactccgcaccgtcaaacgtgaagtcgcctccgcgatatccaggtcacatcgtctgcgcgtcgcggatgtcgttatggtggcgccgggttctattccggtcaccaccagcggtaaggttcggcgttcggccagcgttgagcgttacctacatcacgaattcagccgcctagatgctatggcataacagcgcatgtatgtgggggaagaatatgaccgagtgttttctatctgatcaagagatccgaaagctcaatcgtgaccttcgaatactgatagcagctaatggcaccctcactagggttctcaacattgtcgctgacgatgaggtgatcgtgcaaatcgtcaagcagcggattcacgatgtttcaccgaagctatccgaattcgagcagctagggcaggtgggggtcggccgtgttctgcagcggtacatcatacttaaaggtcggaactcggaacacttatttgtagccgcggagtcgttgattgcgattgatcggttgccggctgcaattataacaaggttgacgcagacaaacgatcctctcggcgaggttatggcagccagccacatcgagaccttcaaggaagaggctaaagtctgggtcggagatttgccaggttggctcgcgctccacgggtatcagaattcccgaaagagagccgttgcccgccgttatcgcgttatttccggaggccagccgatcatggtggtgacggagcactttctacgaagcgtatttcgagatgctccgcatgaagaacctgatcgctggcagttttcaaatgccatcactctggcgcgctagggcggtcatccaataaatgcggaatgggaatctagcggggctcctggctgagcaggcatcggaggcgggatggtacgaccggccggccttctatgcggccgatgtggtgactcatggtcaaatccacgacggtgccgcacgtcttggggaagtgctgagaaaccgcggactatccagtggtgatcgggttctgttgtgcctgccggattcgcccgacctggtgcagctattgctggcgtgcctggctcgtggggttatggcgtttctagcgaatccggagctgcatcgcgacgaccacgcgttggccgcacgcaacacggaaccggcgcttgtcgtcacctcggatgcgctgcgcgatcggtttcagccgtcgcgggtggccgaagccgcggaactcatgtccgaggcggctcgagtcgcgcctggaggctacgaaccgatgggtggtgacgcactcgcatacgctacgtatacgtctggtaccacgggtccgccgaaggcggcgattcatcggcacgccgacccgttgacgttcgtggacgctatgtgtcgtaaagccttgcggctcactcctgaagatactgggctatgtagtgcacgcatgtattttgcttacggcctaggaaattcggtctggtttccactcgcgacaggtggttccgcggtcatcaattcggcgccggtaactccagaagcagcggccattctaagcgcgcgatttgggccatcggtgctctacggtgtgccaaatttctttgccagagtcatcgactcatgttctcctgattccttccgttcgcttcgatgtgtggtgtcagccggggaggcccttgagctgggtcttgccgagcggctcatggaattctttggcggcatccccattctggacggtattggatctacggaggtcgggcagacgttcgtatcgaatcgggttgacgaatggcgcctggggacgctgggaagggtgctgccgccctacgagattcgtgttgtagcgccggatggaacaactgccgggcctggggttgagggcgacctatgggtccgcggaccggcgatcgctaagggctattggaatcggcctgattcccccgtcgcgaatgagggttggctcgacacgcgggacagggtgtgtatcgacagcgacgggtgggttacctaccgctgccgcgccgacgacaccgaggttatcggaggggtcaacgttgatccgcgtgaggtcgagcgactcatcatcgaggacgaagccgtggctgaggccgcggttgtcgcggtaagggagtccacgggcgcgtcgacactgcaggcttttctggttgcgaccagcggtgccaccatcgatgggtcggtcatgcgagaccttcaccgcggattgctcaaccgattgtctgcgttcaaggtgccgcataggtttgccgttgttgatcgactccctcgaaccccgaacgggaaattggtgcgtggcgccctgcagcagcagagtccaaccaaaccgatttgggaactctcgttgactgaacctgggtccggcgtgcgggcgcagcgtgatgacctgtcggcgtccaacatgacgatcgccggaggaaacgacggcggggcgactcttcgcgagcggttggtcgctttgcggcaagaacgtcagcggctggtggtggatgccgtatgcgccgaggccgcgaagatgttaggtgagccagatccttggtcggtcgatcaggatctcgccttctcggagctgggttttgactcgcaaatgacagtcacgctgtgcaagcgattggcggcagttaccggcctgcggttacccgagacggttgggtgggactacgggtcgatatcgggattagcccagtatttggaggccgaactggccggcgggcatggtcgattgaaatcagccggtccggtgaatagcggcgcgacgggtctttgggcaatcgaagagcagttgaacaaggtcgaagagctggtggccgtcatcgccgacggcgagaagcagcgggtggccgaccgtttgcgtgccctgctgggcaccatcgccggcagcgaggcgggcctgggcaagctgatccaggctgcttcgactcctgacgaaattttccagctaatcgattccgaacttgggaagtgatagaggagcaacggacgatgagcgttgaaggtgccgaccagcagagcgaaaagctttttcactacctaaagaaggttgctgtcgagctcgatgagacacgcgctcggctgcgtgaatatgagcaacgcgcgacagaaccggtggcggtggtgggaatcggctgccgatttccgggcggcgtggatggcccggacggactctgggatgtcgtttcggcggggcgcgacgtggtgtcggagtttccgaccgatcggggctgggatgttgaggggctatacgatccggatcccgacgctgagggcaaaacctacacgcgatggggggcatttctagacgacgccaccggctttgacgccgggttcttcggcatcgctcctagtgaagtgttggcgatggatcctcagcagcggttgatgctggaggtttcgtgggaggcgttggagcacgcggggattgacccgttgtcgttgcgtggttcggcgaccggggtgtacaccggcattttcgcggcgagttacggcaatagggataccggggggctgcaagggtacgggttgaccggcacgtcaatcagcgtggcctcgggacgtgtgtcgtacgtattggggctgcagggcccggcggtgtcagtggataccgcttgttcgtcgtcgttggtggcgatccattgggcgatgtcgtcattgcgctccggggagtgtgatttggcgttggccggtggggtgacggtgatggggctgccgtcgatttttgtggggttttcccggcagcgggggttggctgccgatgggcgatgtaaggcgtttgcggccgcggacggcaccgggtggggcgagggcgccggggtggttgtgctggagcggctatcggacgcccggcggttggggcattcggtgctggcggtggtgcgggggagcgcggtcaaccaggatggtgcgtccaatgggctgaccgcgcccaatgggctcgcccagcagcgagtgatccaggtggcgttggccaacgccgggttgtccgccgcagacgtagacgtggtggaggcacacgggaccgccaccacgttgggtgatcccatcgaagcgcaggcattgctgtccacctacgggcagggaggtccagcggagcagccgctgtgggtgggctcaatcaagtcgaacatgggccacacccaggccgccgcgggggtcgccggggtgatcaagatggtgcaggcgatgcgtcatggggtgatgccggcgacgttgcatgtggatgagccttccccgcgggtggattggaccagcggcgcggtgtcggtgttgaccgaggccagggagtggtcggttgacgggcgtccgcgccgggcggcggtgtcctcctttgggatcagcggcaccaacgcgcatctgatcttggaagaggcccccgtaccagcccccgcagaggcgccggttgaggcgagcgaaagcaccgggggccgcggccgtcgatggtgccgtgggtgatttcggcgagatcggctgaggcgttgacggcgcaggcgggtcgacttatggcccacgtgcaggccaacccagggctggatccgatcgatgtggggtgctcgttggccagtcgctcggtgtttgagcaccgagctggtggtcggcgcaagccgtgagcaactgattgccgggctggctgggctcgcggcgggcgagccgggtgccggcgtggcggtcggtcagccagggtcggtgggcaagacggtggtcgtgtttcctgggcagggcgcgcagcgcatcgggatgggccgcgagttgtacggcgagttgcccgtgtttgcgcaggcattcgatgcggtggccgacgagttggaccggcatctgcggttgccgctgcgcgacgttatttggggtgccgatgcggatttgcttgacagcaccgaatttgctcagcccgcgttgttcgcggtggaggtggcatcgttcgcggtgttgcgggattggggtgtgcttccggacttcgtcatgggtcactccgttggagagctggcggcggcgcacgcggccggtgtgttgacgttggcggacgcggcgatgctggtggtggcgcggggccggttgatgcaggcgctgccggcaggcggtgcgatggtggcggtggctgccagtgaggacgaggtggagccgctgctgggtgagggtgtggggatcgctgcgatcaacgcgcccgaatcggtggtgatctccggtgcgcaggccgcggcaaatgcgattgcggatcggttcgccgcgcagggtcggcgggtgcaccagttggcggtctcgcatgcgtttcattcgccgttgatggagccgatgctcgaggagttcgcgcgtgtcgcggcccgggtgcaggcacgcgagccccagcttgggctggtgtcgaacgtgacgggcgagttggccggccctgatttcgggtcggcgcagtactgggtggaccacgttcgtcggccggtgcgcttcgcggacagtgcgcgtcatttgcagacccttggggcgacccacttcatcgaggccggcccgggaagtggtttgactggctcgatcgagcagtccttggccccggctgaggcgatggtggtgtcgatgctgggcaaagaccggcccgagctggcctcggcgctcggtgctgccggtcaggtgttcaccaccggtgtgccggtgcagtggtcggcggtgttcgccggctcgggtggacggcgggtgcagctgcccacgtatgcgtttcagcgacggcggttttgggagacgccgggcgcggatgggcccgccgatgcggccgggttgggtctgggcgcgaccgagcatgccttgttgggtgcggtggtcgagcggcccgattctgacgaggtggtgctgaccggccggttgtcgcttgcggatcagccgtggctggccgaccacgtggtgaacggggtggtgctgttccccggggcgggttttgtggagttggtgatccgcgccggtgatgaggtcgggtgcgcgctcatcgaagagttggtgctggccgcaccgttggtgatgcacccgggtgtcggggttcaggtgcaggtggtcgtcggggctgccgatgaatccgggcaccgtgcggtgtcggtgtattcccgcggtgatcaatcccagggttggttgctgaacgccgaaggcatgctgggggtggctgccgctgagacgccgatggatttgtccgtgtggccgcccgagggcgcggagagtgtggatatctcggacggctatgcgcagttggccgagcgcggttatgcctacggccccgcgtttcagggtctggtggcgatctggcggcgggggtcggagctgttcgccgaagttgtagcccccggcgaggccggcgtggccgtcgaccgaatggggatgcatccggcggtgttggacgcggtgctgcatgccctcgggctggccgtcgagaagacccaggcgagcaccgagacgagactgccgttttgctggcgtggggtgtcgctgcatgccggcggcgctggacgggtgcgggcccgcttcgcgtccgcgggcgcggatgcgatttccgtggacgtctgcgacgccactgggctgccggtgttgacggtgcgctcgctggttactcgcccgataaccgcagaacagctgcgcgccgccgtgaccgcggccggcggtgcgtccgatcaggggccgctggaagtggtgtggtcgccgatctcggtggtcagcggcggcgctaacgggtccgccccacctgccccggtgtcttgggcggacttttgcgccggcagtgatggtgacgccagtgtcgtggtgtgggaactcgagtctgccggtggccaagcatcctcggtggtgggctcggtgtatgcggccacccacaccgccctggaggtgttgcagtcctggctcggcgcggatcgggcggccacgttggtggtgttgacccatggtggcgtggggctggctggcgaggacatcagcgacctggccgccgccgcggtgtggggcatggcgcgttccgcgcaggccgaaaatcccggccggatcgtgttgatcgacaccgatgcggcggtggatgcctcggtgctagccggcgtcggggaaccccagctgctggtgcgcggcggcactgtgcacgccccccggctgtccccggccccggcgttgctagcgttaccggcggcagagtcggcgtggcgattggccgccggtggtggcgggaccctggaggatttggtgatccgctcggaggcgcggtcgcggcgcggctgtggcatgtcggggcgtgccgctcccccggcgccgcccatcggcccgcccattggcattccgcccatgccgcccatcattcctgtggagccagctggcccggtcttcaatggaggcaggcccgctgacggcgacgtggaggcggtgcgccccgaaatctgggccggatctgcctcgctggcctgccgcagttcttcaacctcccggcgcagcttttcgttctcaatttcagcatccctttcggcataccattttatgacggcggcagagtcataaagcacctcattacccttgccaccgcctcgcagaacgggcattccctgttcctgccagttctgaatggtacggatactcgcaccgaaaatgtcagccagctgctttttgttgacttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcaacgaagaacagaacccgcagaacaacaacccgcaacatccgctttcctaaccaaatgattgaacaaattaacatcgctcttgagcaaaaagggtccgggaatttctcagcctgggtcattgaagcctgccgtcggagactaacgtcagaaaagagagcatatacatcaattaaaagtgatgaagaatgaacatcccgcgttcttccctccgaacaggacgatattgtaaattcacttaattacgagggcattgcagtaattgagttgcagttttaccactttcctgacagtgacagactgcgtgttggctctgtcacagactaaatagtttgaatgattagcagttatggtgatccc

SEQ ID NO: 2 - protein, 986 aa, MYCOBACTERIUM TUBERCULOSIS
  hypothetical: YES
MWGARWPVARCLSTELVVGASREQLIAGLAGLAAGEPGAGVAVGQPGSVGKTVVVFPGQGAQRIGMGRELYGELPVFAQAFDAVADELDRHLRLPLRDVIWGADADLLDSTEFAQPALFAVEVASFAVLRDWGVLPDFVMGHSVGELAAAHAAGVLTLADAAMLVVARGRLMQALPAGGAMVAVAASEDEVEPLLGEGVGIAAINAPESVVISGAQAAANAIADRFAAQGRRVHQLAVSHAFHSPLMEPMLEEFARVAARVQAREPQLGLVSNVTGELAGPDFGSAQYWVDHVRRPVRFADSARHLQTLGATHFIEAGPGSGLTGSIEQSLAPAEAMVVSMLGKDRPELASALGAAGQVFTTGVPVQWSAVFAGSGGRRVQLPTYAFQRRRFWETPGADGPADAAGLGLGATEHALLGAVVERPDSDEVVLTGRLSLADQPWLADHVVNGVVLFPGAGFVELVIRAGDEVGCALIEELVLAAPLVMHPGVGVQVQVVVGAADESGHRAVSVYSRGDQSQGWLLNAEGMLGVAAAETPMDLSVWPPEGAESVDISDGYAQLAERGYAYGPAFQGLVAIWRRGSELFAEVVAPGEAGVAVDRMGMHPAVLDAVLHALGLAVEKTQASTETRLPFCWRGVSLHAGGAGRVRARFASAGADAISVDVCDATGLPVLTVRSLVTRPITAEQLRAAVTAAGGASDQGPLEVVWSPISVVSGGANGSAPPAPVSWADFCAGSDGDASVVVWELESAGGQASSVVGSVYAATHTALEVLQSWLGADRAATLVVLTHGGVGLAGEDISDLAAAAVWGMARSAQAENPGRIVLIDTDAAVDASVLAGVGEPQLLVRGGTVHAPRLSPAPALLALPAAESAWRLAAGGGGTLEDLVIRSEARSRRGCGMSGRAAPPAPPIGPPIGIPPMPPIIPVEPAGPVFNGGRPADGDVEAVRPEIWAGSASLACRSSSTSRRSFSFSISASLSAYHFMTAAES

SEQ ID NO: 3 - protein, 495 aa, MYCOBACTERIUM TUBERCULOSIS
  hypothetical: YES
MIEEQRTMSVEGADQQSEKLFHYLKKVAVELDETRARLREYEQRATEPVAVVGIGCRFPGGVDGPDGLWDVVSAGRDVVSEFPTDRGWDVEGLYDPDPDAEGKTYTRWGAFLDDATGFDAGFFGIAPSEVLAMDPQQRLMLEVSWEALEHAGIDPLSLRGSATGVYTGIFAASYGNRDTGGLQGYGLTGTSISVASGRVSYVLGLQGPAVSVDTACSSSLVAIHWAMSSLRSGECDLALAGGVTVMGLPSIFVGFSRQRGLAADGRCKAFAAADGTGWGEGAGVVVLERLSDARRLGHSVLAVVRGSAVNQDGASNGLTAPNGLAQQRVIQVALANAGLSAADVDVVEAHGTATTLGDPIEAQALLSTYGQGGPAEQPLWVGSIKSNMGHTQAAAGVAGVIKMVQAMRHGVMPATLHVDEPSPRVDWTSGAVSVLTEAREWSVDGRPRRAAVSSFGISGTNAHLILEEAPVPAPAEAPVEASESTGGRGRRWCRG

SEQ ID NO: 4 - protein, 705 aa, MYCOBACTERIUM TUBERCULOSIS
  hypothetical: YES
MRNGNLAGLLAEQASEAGWYDRPAFYAADVVTHGQIHDGAARLGEVLRNRGLSSGDRVLLCLPDSPDLVQLLLACLARGVMAFLANPELHRDDHALAARNTEPALVVTSDALRDRFQPSRVAEAAELMSEAARVAPGGYEPMGGDALAYATYTSGTTGPPKAAIHRHADPLTFVDAMCRKALRLTPEDTGLCSARMYFAYGLGNSVWFPLATGGSAVINSAPVTPEAAAILSARFGPSVLYGVPNFFARVIDSCSPDSFRSLRCVVSAGEALELGLAERLMEFFGGIPILDGIGSTEVGQTFVSNRVDEWRLGTLGRVLPPYEIRVVAPDGTTAGPGVEGDLWVRGPAIAKGYWNRPDSPVANEGWLDTRDRVCIDSDGWVTYRCRADDTEVIGGVNVDPREVERLIIEDEAVAEAAVVAVRESTGASTLQAFLVATSGATIDGSVMRDLHRGLLNRLSAFKVPHRFAVVDRLPRTPNGKLVRGALQQQSPTKPIWELSLTEPGSGVRAQRDDLSASNMTIAGGNDGGATLRERLVALRQERQRLVVDAVCAEAAKMLGEPDPWSVDQDLAFSELGFDSQMTVTLCKRLAAVTGLRLPETVGWDYGSISGLAQYLEAELAGGHGRLKSAGPVNSGATGLWAIEEQLNKVEELVAVIADGEKQRVADRLRALLGTIAGSEAGLGKLIQAASTPDEIFQLIDSELGK

SEQ ID NO: 5 - protein, 411 aa, MYCOBACTERIUM TUBERCULOSIS
  hypothetical: YES
MKTNSSFHAAGEVATQPAWGTGEQAAQPLNGSTSRFAMSESSLADLLQKAASQYPNRAAYKFIDYDTDPAGFTETVTWWQVHRRAMIVAEELWIYASSGDRVAILAPQGLEYIIAFMGVLQAGLIAVPLPVPQFGIHDERISSALRDSAPSIILTTSSVIDEVTTYAPHACAAQGQSAPIVVAVDALDLSSSRALDPTRFERPSTAYLQYTSGSTRAPAGVVLSHKNVITNCVQLMSDYIGDSEKVPSTPVSWLPFYHDMGLMLGIILPMINQDTAVLMSPMAFLQRPARWMQLLAKHRAQISSAPNFGFELAVRRTSDDDMAGLDLGHVRTIVTGAERVNVATLRRFTERFAPFNLSGRQSGRHMGSRRRRCTWRPPDRDARRRVFALTTSSCRSVRRSVPRTAAREPTW

SEQ ID NO: 6 - protein, 452 aa, MYCOBACTERIUM TUBERCULOSIS
  hypothetical: YES
MSCVYATASRWGGPPVASEVRGDAAISTTPDAAPGLAARRRRILFVAEAVTLAHVVRPFALAQSLDPSRYEVHFACDPRYNQLLGPLPFRHHAIHTIPSERFFGNLTQGRFYAMRTLRKYVEADLRVLDEIAPDLVVGDLRISLSVSARLAGIPYIAIANAYWSPYAQRRFPLPDVIWTRLFGVRLVKLLYRLERPLLFALQCMPLNWVRRRHGLSSLGWNLCRIFTDGDHTLYADVPELMPTYDLPANHEYLGPVLWSPAGKPPTWWDSLPTDRPIVYATLGTSGGRNLLQLVLNALAELPVTVIAATAARGDLKTVPANAFVADYLPGEAAAARSAVVVCNGGSLTTQQALVAGVPVIGVAGNLDQHLNMEAVERAGAGVLLRTERLKSQRVAGAVMQVISRSEYPTSRRATRRCLRTRPRWIPAACGECSAPHAGEPAPDMVGQLVTST

SEQ ID NO: 7 - protein, 463 aa, MYCOBACTERIUM TUBERCULOSIS
  hypothetical: YES
MEETSVAGDPGPDAGTSTAPNAAPEPVARRQRILFVGEAATLAHVVRPFVLARSLDPSRYEVHFACDPRFNKLLGPLPFPHHPIHTVPSEEVLLKIAQGRLFYNTRTLRKYIAADRKILNEIAPDVVVGDNRLSLSVSARLAGIPYIAIANAYWSPQARRRFPLPDVPWTRFFGVRPVSILYRLYRPLIFALYCLPLNWLRRKHGLSSLGWDLCRIFTDGDYTLYADVPELVPTYNLPANHRYLGPVLWSPDVKPPTWWHSLPTDRPIIYATLGSSGGKNLLQVVLNALADLPVTVIAATAGRNHLKNVPANAFVADYLPGEAAAARLAVVLCNGGSPTTQQALAAGVPVIGLPSNMDQHLNMEALERAGAGVLLRTERLNTEGVAAAVKQVLSGAEFRQAARRLPKPSDQTLPDSRSTSKVRCGSSAKGCPRYRRLANGCPVEHLIRERVAVQNAEVPQRLS

SEQ ID NO: 8 - protein, 219 aa, MYCOBACTERIUM TUBERCULOSIS
  hypothetical: YES
MDLPLEASDEPNRAHINLYHRTATQVDLGGKQVLEVSCGHGGGASYLTRTLHPASYTGLDLNQAGIKLCKKRHRLPGLDFVRGDAENLPFDDESFDVVLNVEASHCYPHFRRFLAEVVRVLRPGGYFPYADLRPNNEIAAWEADLAATPLRQLSQRQINAEVLRGIGNNSQKSRDLVDRHLPAFLRFAGREFIGVQGTQLSRYLEGGELSYRMYCFTKD

SEQ ID NO: 9 - protein, 161 aa, MYCOBACTERIUM TUBERCULOSIS
  hypothetical: YES
MTGAVCPGSFDPVTLGHVDIFERAAAQFDEVVVAILVNPAKTGMFDLDERIAMVKESTTHLPNLRVQVGHGLVVDFVRSCGMTAIVKGLRTGTDFEYELQMAQMNKHIAGVDTFFVATAPRYSFVSSSLAKEVAMLGGDVSELLPEPVNRRLRDRLNTERT

SEQ ID NO: 10 - protein, 1124 aa, MYCOBACTERIUM TUBERCULOSIS
  hypothetical: YES
MFSKVLVANRGEIAIRAFRAAYELGVGTVAVYPYEDRNSQHRLKADESYQIGDIGHPVHAYLSVDEIVATARRAGADAIYPGYGFLSENPDLAAACAAAGISFVGPSAEVLELAGNKSRAIAAAREAGLPVLMSSAPSASVDELLSVAAGMPFPLFVKAVAGGGGRGMRRVGDIAALPEAIEAASREAESAFGDPTVYLEQAVINPRHIEVQILADNLGDVIHLYERDCSVQRRHQKVIELAPAPHLDAELRYKMCVDAVAFARHIGYSCAGTVEFLLDERGEYVFIEMNPRVQVEHTVTEEITDVDLVASQLRIAAGETLEQLGLRQEDIAPHGAALQCRITTEDPANGFRPTRAGSARCDPPAVPVSAWTAAPTWRRNQPVLRLHAGQADLSGRDLPTAVSRARRAIAEFRIRGVSTNIPFLQAVLDDPDFRAGRVTTSFIDERPQLLTARASADRGTKILNFLADVTVNNPYGSRPSTIYPDDKLPDLDLRAAPPAGSKQRLVKLGPEGFARWLRESAAVGVTDTTFRDAHQSLLATRVRTSGLSRVAPYLARTMPQLLSVECWGGATYDVALRFLKEDPWERLATLRAAMPNICLQMLLRGRNTVGYTPYPEIVTSAFVQEATATGIDIFRIFDALNNIESMRPAIDAVRETGSAIAEVAMCYTGDLTDPGEQLYTLDYYLKLAEQIVDAGAHVLAIKDMAGLLRPPAAQRLVSALRSRFDLPVHLHTHDTPGGQLASYVAAWHAGADAVDGAAAPLAGTTSQPALSSIVAAAAHTEYDTGLSLSAVCALEPYWEALRKVYAPFESGLPGPTGRVYHHEIPGGQLSNLRQQAIALGLGDRFEEIEEAYAGADRVLGRLVKVTPTSKVVGDLALALVGAGVSADEFASDPARFGIPESVLGFLRGELGDPPGGWPEPLRTAALAGRGAARPTAQLAADDEIALSSVGAKRQATLNRLLFPSPTKEFNEHREAYGDTSQLSANQFFYGLRQGEEHRVKLERGVELLIGLEAISEPDERGMRTVMCILNGQLRPVLVRDRSIASAVPAAEKADRGNPGHIAAPFAGVVTVGVCVGERVGAGQTIATIEAMKMEAPITAPVAGTVERVAVSDTAEWRAETCWWW

SEQ ID NO: 11 - protein, 305 aa, MYCOBACTERIUM TUBERCULOSIS
  hypothetical: YES
MTAHATPNEPDYPPPPGGPPPPADIGRLLLRCHDRPGIIAAVSTFLARAGANIISLDQHSTAPEGGTFLQRAIFHLPGLTAAVDELQRDFGSTVADKFGIDYRFAEAAKPKRVAIMASTEDHCLLDLLWRNRRGELEMSVVMVIANHPDLAAHVRPFGVPFIHIPATRDTRTEAEQRQLQLLSGNVDLVVLARYMQILSPGFLEAIGCPLINIHHSFLPAFTGAAPYQRARERGVKLIGATAHYVTEVLDEGPIIEQDVVRVDHTHTVDDLVRVGADVERAVLSRAVLWHCQDRVIVHHNQTIVF

SEQ ID NO: 12 - protein, 406 aa, MYCOBACTERIUM TUBERCULOSIS
  hypothetical: YES
MTSTKVEDRVTAAVLGAIGHALALTASMTWEILWALILGFALSAVVQAVVRRSTIVTLLGDDRPRTLVIATGLGAASSSCSYAAVALARSLFRKGANFTAAMAFEIGSTNLVVELGIILALLMGWQFTAAEFVGGPIMILVLAVLFRLFVGARLIDAAREQAERGLAGSMEGHAAMDMSIKREGSFWRRLLSPPGFTSIAHVFVMEWLAILRDLILGLLIAGAIAAWVPESFWQSFFLANHPAWSAVWGPIIGPIVAIVSFVCSIGNVPLAAVLWNGGISFGGVIAFIFADLLILPILNIYRKYYGARMMLVLLGTFYASMVVAGYLIELLFGTTNLIPSQRSATVMTAEISWNYTTWLNVIFLVIAAALVVRFITSGGLPMLRMMGGSPDAPHDHHDRHDDHLGH

SEQ ID NO: 13 - protein, 202 aa, MYCOBACTERIUM TUBERCULOSIS
  hypothetical: YES
MRWGYRPLARESGALDPDHRRCRRRRRIAVPPRGTRPTTDRVRESLFNIVTARRDLTGLAVLDLYAGSGALGLEALSRGAASVLFVESDQRSAAVIARNIEALGLSGATLRRGAVAAVVAAGTTSPVDLVLADPPYNVDSADVDAILAALGTNGWTREGTVAVVERATTCAPLTWPEGWRRWPQRVYGDTRLELAERLFANV

SEQ ID NO: 14 - protein, 241 aa, MYCOBACTERIUM TUBERCULOSIS
  hypothetical: YES
MRLPGMLRPTAERHFHSIFYLRHNARRQEHLATLGLDLGNKSVLEVGAGIGDHTQFFLDRGCKVLCTEPRGENLDVIRQRFGSNPNVTVDHLDLDGDLPAEAHQYDVVYCYGVLYHLSRPAEALAWMCDRAVDLLLLETCVSYSGEDEPFLVSERASSPSQAITGTGCRPSRVWVMNRLREKMPHVYVTATQPRHRQFPLDWRANGPIASTGLARAVFVASRAPLNLPTLVEELPMVQRRC

SEQ ID NO: 15 - protein, 212 aa, MYCOBACTERIUM TUBERCULOSIS
  hypothetical: YES
MKQLKSRRVDVVFDVGANSGQYAAGLRRAAYKGRIVSFEPLSGPFTILESKASTDPLWDCRQHALGDSDGTVTINIAGNAGQSSSVLPMLKSHQNAFPPANYVGTQEASIHRLDSVAPEFLGMNGVAFLKVDVQGFEKQVLAGGKSTIDDHCVGMQLELSFLPLYEGGMLIPEALDLVYSLGFTLTGLLPCFIDANNGRMLQADGIFFREDD

SEQ ID NO: 16 - protein, 274 aa, MYCOBACTERIUM TUBERCULOSIS
  hypothetical: YES
MQTKRYAGLTAANTKKVAMAAPMFSIIIPTLNVAAVLPACLDSIARQTCGDFELVLVDGGSTDETLDIANIFAPNLGERLIIHRDTDQGVYDAMNRGVDLATGTWLLFLGADDSLYEADTLARVAAFIGEHEPSDLVYGDVIMRSTNFRWGGAFDLDRLLFKRNICHQAIFYRRGLFGTIGPYNLRYRVLADWDFNIRCFSNPALVTRYMHVVVASYNEFGGLSNTIVDKEFLKRLPMSTRLGIRLVIVLVRRWPKVISRAMVMRTVISWRRRR

SEQ ID NO: 17 - protein, 332 aa, MYCOBACTERIUM TUBERCULOSIS
  hypothetical: YES
MPRSIATSEYLGIAAKFVPKIDANYEPWTMLGNLAFGLPSRLRLGVCVTDAGRRNPAVTAQAAATLHLLTRGRAILGIGVGEREGNEPYGVEWTKPVARFEEALATIRALWNSNGELISRESPYFPLHNALFDLPPYRGKWPEIWVAGPRMLRATGRYADAWIPIVVVRPSDYSRALEAVRSAASDAGRDPMSITPAAVRGIITGRNRDDVEEALESVVVKMTALGVPGEAWARHGVEHPMGADFSGVQDIIPQTMDKQTVLSYAAKVPAALMKEVVFSGTPDEVIDQVAEWRDHGLRYVVLINGSLVNPSLRKTVTAVLPHAKVLRGLKKL

SEQ ID NO: 18 - protein, 209 aa, MYCOBACTERIUM TUBERCULOSIS
  hypothetical: YES
MAARPAERSGDPAAVRVPVPSAWWVLIGGVIGLFASMTLTVEKVRILLDPIYVPSCNVNPIVSCGSVMTTPQASLLGFPNPLLGIAGFTVVVVTGVLAVAKVPLPRWYWIGLAVGILVGVAFVHWLIFQSLYRIGALCPYCMVVWAVIATLLVVVASIVFGPMRENRGSQERVGARLLYQWRWSLATLWFTTVFLLIMVRFWDYWSTLI

SEQ ID NO: 19 - protein, 312 aa, MYCOBACTERIUM TUBERCULOSIS
  hypothetical: YES
MRHAKPPRSSLQRWRPFGLPPHRWRLAPWYWRGLQVTLEPGSAIAWIVRLTGGFEETEIDIAAALYSALYPDRCILDVGANVGIHSLAWARLAPVVALEPAPGTHSRLEANVAANGLQDRIRTLRTAAGDAVGEVDFFVAADSAFSSLNDTGRIRIRERTRVPCTTLDALAAELPLPVGLLKIDVEGLERAVIAGAAELLRRDRPVLLVEIYGGAASNPDRNGPLRTSARTVTNRSSTPTMRGCSPTNGTATTGTATSLFRAGRDSWRRLPLSTSSACPGRLRCWVAVASRAKRAWARGGRYAGAADVSAAR

SEQ ID NO: 20 - protein, 199 aa, MYCOBACTERIUM TUBERCULOSIS
  hypothetical: YES
MTECFLSDQEIRKLNRDLRILIAANGTLTRVLNIVADDEVIVQIVKQRIHDVSPKLSEFEQLGQVGVGRVLQRYIILKGRNSEHLFVAAESLIAIDRLPAAIITRLTQTNDPLGEVMAASHIETFKEEAKVWVGDLPGWLALHGYQNSRKRAVARRYRVISGGQPIMVVTEHFLRSVFRDAPHEEPDRWQFSNAITLAR

SEQ ID NO: 21 - protein, 299 aa, MYCOBACTERIUM TUBERCULOSIS
  hypothetical: YES
SPRCARTLAGFESRLACRRYARGAVALTAAATSRQIEHVRISETVADKSKRPPRFDLKSADGSFGRLVQIGGTTIVVVFAVVLVFYIVTSRDDKKDGVAGPGDAVRVTSSKLVTQPGTSNPKAVVSFYEDFLCPACGIFERGFGPTVSKLVDIGAVAADYTMVAILDSASNQHYSSRAAAAAYCVADESIEAFRRFHAALFSKDIQPAELGKDFPDNARLIELAREAGVVGKVPDCINSGKYIEKVDGLAAAVNVHATPTVRVNGTEYEWSTPAALVAKIKEIVGDVPGIDSAAATATS

SEQ ID NO: 22 - protein, 112 aa, MYCOBACTERIUM TUBERCULOSIS
  hypothetical: YES
MLHGVIQDDAIVVVDDLGLVPELDRPRPSAVGRNATAVVSLPVVALSPRAGQAGYLWQSITRGLRVTPICCYHPPCGGGVQKMLSRKLGRVCPAPSPKDAARGAHNVGANAV

SEQ ID NO: 23 - DNA (genomic), 37769 bp, MYCOBACTERIUM LEPRAE; double-stranded, circular
  hypothetical: NO
  anti-sense: NO
ctttacgaggaacgcaggtcgagcgggctagcatgcgatggtgacacccacctctggtaaagatagtgccatcggctggcccacccgcttgtccaaggcccgtttgcatcttgttacaggcaaaggcggtaccggaaagtcgacgatcgctgccgcgttggcactgaccctggcagcaggaggccgcaaagtccttctcatcgaagtcgaagggcgccaagggattgcacaactcttcgatgtcccacccctgccttaccaagaactaaaaatcgcaaccgctgcgggtggcggccaggtcaacgccttggccatcgacatcgaggccgcgttcttggaatacctcgacatgttctacaacctgggccttgccgggcgggctatgcgccgcatcggtgcgatcgagttcgcaacaacgatcgctcccggtctgcgcgacgtgctgctcaccggtaagatcaaagagtcggtggttcgcataaacaaaggagccaaaaacccagtctatgacgcgatagttgtcgatgcgccgccgaccggccgcatcacgcgtttcctggatgtcaccaaagcggtgtccaatttggccaaggacggaccagtgcactcgcaaagccaaggcgtggtggagttgctgcactccgaccagactgctatccacctagtcaccctgctcgaggcattgccagtacaagagacgctggaagccattcaggagcttgccgacatggagctaccgatcggcagcgtgatcgtgaaccgcaacataccgtgctacctagggcaccacgacctggcaaaggtggcagagggtgacatcgacgcagacacagtgcggaagggattagcgatggccggaatcaagctcaacgacgccgacttcgccggcctgctgaccgaaaccattcagtatgctatggtaattaccacgcgcgccgaggcagctcagcagctggacaccttgcaggtaccacgactagacctaccggccatctccgacggagtcgaccttggtaacctgtatgagctttcggaatcgcttgcacaacagggggttcgatgactgcccctacttcccacaggccgcctaccctcgatatggcagcgattttggcggacacttccaatcgagtggtggtgtgctgcggcgccgggggcgtaggcaaaacgaccactgcggccgcgatggcgttacaggcggccgaatatggccgcactgtagtcgttttgacgatcgacccggccaagcggttagcacaggcattgggagtcaacgacctcggcaacaccccacagcgggtcccgctagcacccgaagtccccggtgaattgcacgcgatgatgcttgacatgcgccgcacattcgacgaaatggtcgtccaatactccggaccggagcgggcacaagcgattctgaatagcgaattctatcaaacggtcgccacatcgcttgctggcacgcaagagtatatggcaatggagaagctcggtcaactacttagccaggaccgctgggacttggtagtggtcgataccccgccgtcacgcaacgcactggatttcctggacgcgccaaaacggttgggaaacttcatgaatagccgactggggaggctgctactcacccccggacgaggtatcgggcggctggtgaccggagccatgggattggcgatgagagccctgtctacggtgctcggttcacagatgctggccgacgcagcaactttcgtgcaatcgctggacgcgacattcggcggtttccgcggaaaagccgatcgcacctacgcgctgctgaagcagcgcggcacccagttcgtggtggtatcggcggccgaacccgacgcactgcgcgaggcgtccttcttcgtcgaccggctatcgcaggaaaatatgccgctggcgggctcatgttaaatcgcacccacccgacattgtgcgcgttgcccgtggagcaggcgatcgacgcaagcaagacgctgcaagacgagatcaccaattccgcggccgcatccctggcgacagcagtgctgaggattcatgccgaccgcgggcagaccgccaagcgcgaggcccggttgctgtctcgcttcaccggcgctaacccccacgtaccagtcatcgggataccgttgctgccgttcgacgtatcggacctagaggcgctgcgtgcgatcgccgatcgcctcactgcgagccactgaagaaccccgggaatagtaacaagttaagtaactttgagtaatgcgggccttccggaggcgtcctcggtgaactaaagcccctgatcgactgagcctatacaaacttagctaacattgcggtgcttgcgcgtgtcgaagaaatccgcccacgacacgacctcgggatgctgcttgagcagtgcccgcgctggcgctcggtcatgcctccccaaacaccgaactcaaccttgttgtccaacgcgtctgcccgacactcctgcattaccgggcagtgacgacagatcaccgcggctttacgttgagcggcaccccggacaaataactcatccggatccgtcgcccgacacaacgctttggaaacccaggcaatgcgctcctcggcgtcgacactatggagaggactcttggcggcggacaggtttgttctacgggcggccggtcgtgtttttgccacgagctgttaccttcctcccggccgcaattcacggccgccttcctctggtgaagaccgttatgcgatctacgccacaccatcttcatagttgttatatatctcactgtgagtctacagttaagtgtgaccagaggccaattgcacaacaatctgataacgcttttttaaggacaagcgttccttcccgacgtgatcatggtaaggagcactgcgcaccacttttaggagccaaccagtgacgcgtaggagccaaccagcgacgcgcacgaaaacttcggtgctgatcatcgacaaagttgctgataaccagtcgctcaagatttctatgcgacttcactgctagtcgccacaactgggggctaccgtagtacacatgtcagagcgcctcccagccgtcctcgcagttctcaagcttgcggggtattgcctattggccggcgttgtcaccaccgcaatgatgttcccgttggccggcggactgggggtgatatccaaccgtgcttcggaagtggtagccaacggatcggcccaacttctcgagggcgaggtgcccgcggtatcgacaatggtcgacgcgaagggaaacacgatcgcgtggctgtactcgcaacgccgattcgaggtacccaccgacaagatcgccaacaccatgaagctggccatcgtttccatcgaggataaacgctttaccgaccacaacggtgtggactggccgggcaccctgaccggactggccggctacgactccggcgacgtggacactcgcggcggttcgacgatcgagcagcagtacgtgaaaaactatcagttactggtaaccgctcaaaccgacgccgaaaaacgtgcggccgtcgaaaccaccccggcacgcaagctgcgcgagatccggatagcgctcacgctggacaagacgttcaccaaacccgagatcctgacccgctacttgaacctggtgtcgttcggcaacaactctttcggcgtgcaagatgcagcgcagacctacttcggcgtcaacgcgtccgacctaaattggcaacaagcagcactactcgccggcatggtgcaatcgaccagcacgctcaacccgtacaccaaccctgaaggcgcgttggcccggcgaaacttggtgctggacaccatgatcgaaaacctaccgcaggacgccgaggcactgcgcgccgccaagactgagccgctggggatattgccacggcccaacgagctgcctcggggctgcatcgcggcaggcgaccgagcattcttctgcgactatgtccaggagtatttgtcccacgccgggatcagcaaagatcggctagccaagggcggctacctcatccgcaccactcttgaccctaacgtccaagccccggtcaaagcggccatcgacaagttcgccagcccaaacctggcgggcatctccagtgtgatgagcgtaatcaccccgggcaaagatgcccatcgcgtgatcgcgatgggcagcaaccgcagatacgggctagacaccgaggccggtgaaaccatgcgaccacagacattttccctggtcggcgacggggctgggtcggtcttcaagatcttcaccacggccgccgcactggacatggggatgggcatcaacgccaaactcgaggttccgagccggttccaggccaaagggatgggaagcggcggagccaaggggtgccctaaggaaacctggtgcgtgatcaacgccggtaattaccgagggtcgatgaacgtcaccgacgccctagccacctcacccaacaccgcattcgccaagctgatccagcaagtcggggtggcgcgcacggtggacatggcgatcaaactcgggttgcggtcctatacaacccccggcacagcccgcgactataatccggacagcaacgaaagcttagccgacttcgtaaaacggcagaacatcggttcgttcaccctgggcccgatcaaggtcaacgcgctggagttatcgaatgtcgcggcgacgctggcatcgggtgggatgtggtgcccgccgaacccaattgacaaactgttcgaccgtaacggcaacgaagttgccgttacggtcgagacctgcgatcgggtggtgcccgagggtttggccaacacgttggccaacgcaatgagcaaagacacaaagggcagcggcaccgcggccggttctgccggtgcagcaggctgggatctaccaatgtcaggcaaaactggcaccacagaagcccaccgatcctccggcttcgtaggtttcaccaaccactacgcagcggccaactatatctacgacgattccacctcgccaacgaatctgtgctccggtccactgcggcactgcagcaacggtgacttatacggcggtaacgagccagcccgaacctggttcaccgcgatgaagccgatcgccaccaaattcggtgaagtccgcttgccaccgaccgatccgcgctacgtcgacggttctcccggttcacaggtgccaagcgtgaccggactggacctggacgcggcgcgccagcgcctgaagggggcaggtttccaggttgccgatcagcccaccttgatcaacagcaccgccaagctcggcgcagtggtcggcaccacacccagcggccaaacaattccgggttcgatcattacaattcaaaccagcagcggcataccgccggctccgcccgccgccggaaggcggcccgccgatgccaccctcggttggatcgcaggtcatcgaaattcccggcttgccgccaatcaccattccgctactagcgcctccgtaaacccgcaaagggcgctttgccaacggacttgcgttgtcttgtcggtccgagactaacagtaggctgcttgcatggctgacacacgcctgactaccccactttccccctcgccgctgcgctgctggagacgcctccacactggtcctgcggcccgcgcgaaagtcaggggtcaccgagcatggcccattttgatccgcaccggtgccttagtgctcagctccgcagccacaggggccggttatgcctcgatcgtcgagcgcaacgcgttcgtcctacgtgagctgaccattccaatcttgacgccgggctccacgccattgcgagtactgcatatcagcgatatccatatgatgccccaccagcgtcgcaaacaagcctggctccgcgacctggccacctggcaacccgacctggtagtcaacaccggtgacaacttggcgcatcccaaggcagtacccggggtgatccaagcattgggcaatctgctgtctcggccaggtgtctttgtgttcggcagcaatgactacttcggaccacacctaaagaatccggtgaactacctgaccaacccgacgcaccgggtccgtggtaaaccgttgccgtggaaggatctgcgggcagcgttcactgaacgcggctggcttgacctgacccacacccgtcgcgagttcgaggtagctggactgcacattgccgccgcaggcgtggatgacccgcacatcagccgggaccggtacgacacaattgcaggccccgccagcccggttgcgaacctgcgactggggttgacccattcgccggaaccgcgggtgctggatcgcttcgccgccgactgctaccagctggtgatggccggccacacccacggcggccaattgtgcctgccgttctacggagccctagtcaccaactgtggcctggaccggtctcgggcgaaggggctatcacgctgggatgcggatatgcggttgcatgtctccgcgggaataggcacctcaccgcttgcgccaatgcgattctgctgccgacccgaagcaaccctgctgacgttgatcgccaccccgatgggtagtcgagtcgagagtcccgtaagaaccggggccgttcgcaaccaacagctgcagtgcgttgaacgggcacatcgagatagcgggccacgacctcccacgcaactggactgacaacgcaatccagctgatcgagaccgacgctcgtcgcagtgctgacacccacttgctacggtacccgcctgctgtcggcctgatacatagatgtcgacatcgatctgtacctcaaagacgagacaacccgtataaccggcagtctcaaacaccaactgagacgctcgtcgttactctatgcgctgtggcaaaaagtgtatcaacgaaggcatcacgatggtggaggcgacggcggtctccgaggtctgcttcgcaggcattgctcggtctgccgttcatctcttgtgatgccggcggcaacccagtgcttctaaggtggcactcatcgactcacaaggcgaaccagtgccatttcgtgaagaactcaagcaagatatctacgcctaggctcaacgtctcgcgcagaataacagcggcactatctggaccaggttgccaacaccgagcaggcgaccgactgacgcggcaacaacaacatcgtcgaatcggatctaaattacaaatactcgaagagaaacacctcattccgagatggattgtgatagaaactggcactggcggaaccagcgcgacgatcgtccgctccatccgttaccggcggtacggtacgtacgccaaagttcgatacgacatcgtcatgcccacgtcgtcctgcatcgagggcatagggcgaccgctggctgagccatcattcctgcccggggtggtcgaccggcatgttcgcggttccaaacccagcatcgatcgtcgccacccgcagggaacgttcgtcctgctcaccgagatggtagccacaaccgttcggtggtcactttgctcgacgacagtggcaaccactacgtcgacccctaatgcaacgacgactgggggcagcgcccaaggatgcaatctcaacaggcctgccgagacgctggtgaagttcgaacgatcgtgccattggagagctgactcgcactgcctagggcaccgcaatttggccagtatgacggccggtgcgataggctgtcgtcgcttaaagcggggtgtggcgcagcttggtagcgcgcttcgttcgggacgaagaggccgtgggttcaaatcccgccaccccgactgaaagtgcccggtggcaaaggttgtcaccccagatagttttcttggccgggctgttgtcattgacggcaaccaattacggcttgagcacaacgttgctaacagccgtctagccagaacggcgaatcctgacccgatggatctagaaatgttgcaaaccctgctcaagtcctagggcaagattccggataccgcagtcgcgcgggtgagcgcacaggttaggtgtcgcgccaactcgctgcgtcaacagctcgagcacgatcttggataaactcgaaagccacggcgattcggggctgaagagcatccaagacctcgcaggtttaaggattgtcaccgatatgaatcgcaaggaacaaaatgatcgggttcgccgagaaatcaaggtccgccggccacgacaatcaccgccgccacttcctcagcctgcgcggtgacggcgtcccggtaactaccccgacacgacgggccattgctaacttctttctgttccgcacacagtaatgagatcctttccggcgaaatggttctgactctttcacctaactgtcgacgaaagtgactgcaccatcgcgtacattgctgccacctctgccgatgcaaacagacaggcctatgcagtaaccaggccgttcatggaaaacggtgtcctgaagtaagtcgcttcggggtctaagacgactgtcttggtttcgtctgaccaggtcacgatttagcgggccatctgctcgaacgagatcttcttcggccttatgacattcacgatgccgcccaatcgttcacctgtgccacacgggcgacctcggctgcgagttcggcggcaacgataggctggataaacgcgtccggtagtcgcacctcaccgtcggccatgagctacgccgaactcgcatcggtgaattccgcgaactgggtggctcgcacgatcaagtaaatatggaatttccgattcttcgaagagcttctcttgaacgatcttcgcccgctagtagtagcttaggataaattgttcgacatcaacgattaacatctacgacgtagtgtccaacgtcagctgctttcgcagcagccaccaaaatagccgtcaatttagtgaaaaatccgtagcgtggtagcgcattttgtctacaattctttccccgagtaccccagttccaccaatcgcaacgtcttcactgttttccctatcagaaattgtaccgagacgctgtaagcgcacgtccccaaatttagttggtgatacgcaatacccaagcgtagaaatacgttaaagtcgtcggtgaaggattctgggtccggttacagcgtcgacatagcagtactgactggataccacgtccgttccgcttgtggtccaccacgacgaaccccgtcagcaagccttccagatactaagaatcccgctcgacaccgatgttcttcaccgatgggttagtctagcgaaaatacaaggctatttacgacgaaatcacctacacagcaaactcttgagtagatagaatgggttttccattaaactgccgtggcagatgctatgcttcgcggcctggctccaacagcgggatatggcggggatgccgcgatggtgataataccggcaccaacagaagccgattcgaaccgaatatagatattttcccggataaaatcgcgatattaggcaccggcttgccaggtggctgctggcttctgacattacggaagcactgggaaccgacaccgtgttcgctgtcaacgctgcatgcaccaacagcgttgagcacacacatcgcggacacaatgtcggaaaaatgctaattgaagttgatgttgtagcaaaatccactgtcgggtagccgattacagctcgtggaaggaaccgaccgtcgacccgaggaatagcggacgaagcttgatactaatcagggccatcaacaactcggtagagctggacaaggcttcacccggaaccacgctacgatatctcctaccgtagtgtgcctatctttcctgaactggagccaccgtacatgaaatagcctgcggtcaaggcgtgatcgtatgaactcctcctgcactaccgcataagtaaactgttttcattgacccgcagtaggggacaagatggatgtgactcgctcaccgattacccatggctggctgcctgccgtgcccagtggggaacgggagtccagcaacctacataggtcgagcccttaacctatcgttggcaaacggatcactatcgacggccgtgcgacgcatcttcaccgtacccgcaccgcatccacataagcgcatctgcacgtgattcggactctgacttgcagctggcctattcatttgctaagagctgcattaccgaggttttgcatacgtggacgcggcctggtaatggaatccaatgttgctgcagctaggtgcagaattggagcgggctttcctggcaggcgtgtgccacgacgtcagttcaatcgaaccaggctaaacattggtaaccgaatggaagtgctctcaacagatccccgcggatagcacagttccatcatactgtttacgcgacaacagaagctgacagcagatgcgcgaatacttcatgcacagatcgttgtatttgtataacctcacgacaggctatccgcacgcctggacgattccaccgtctaacagacgatggccaagacaatgttcggggcgatcgaattcgacgagtacggcgcggaggcaccgcttgcggctgcacccaccagctcttcacttaatctattggctgtgtcagatctggattcggcgtatcggtacggcattgaagtcgccctcgccgaatcactagtggcggtgaccctgatgttgctattcggcttgcatcactaaaatgcgcggcgcctcaactgggcacttcgtgtcgacgaactcgccacgtttgcgggattctctagccaataccctgacaacctcgtcgtcagggagctatctcgcctgtttatccgagagtacctcggtctggatcgcggccagcaacttgggtcttagaaaccgcaacgcgggtacagtcactgggaaagattgcgatgggcctgcgggtggtttccgacgacggtagcccggaacatttccggcaggcgctgtttcgcgtgctggcgtcggtggtggaaatctggatgttgttaggaagtcccgcggtaatctgcagcatgttgtcacctaaggccaaacatatcggcgatatctttcccggcacagtcgtaatcagtgaacgccgtcctcagcgcggtccttcgccggctatgccaccgtcattggcgtggtgggcgtcgtcgctgcagctatcgggcctcaacactaggcaggccgagctcgcacaccaattcctttcccgagcaccgcaacttgatccccaactacaagaacaaatggcttaccggattactggtgacgtgatgtctcgtatagccccaccacccccgtccagcaccccgccacaactgatgctggccgccgtgctcgccgaaagacatcgccataagctggtacagcttcgtccaacaccggtcggcccgacaccgtcgtcaccgacggtgtccaaatatcccgtccctccccgggttgcctgggcaggcatttgcagcacccaattcctagtcgcatccggacatcggtagattttcgctcctttcgctaatgcacggccacggccgccagtgtggcgaagttggcaaccaacagcgccccatcgacacagtgagactgcgatgctcgcggggcgtttcacgaaaaaagcagagtacccgatgaccaacaccgccagcagaggttagccgtagaacaacacgcctaaatcaatctccccagatcctgggttggtacataggtgaccatcggtactcatcacggcacgaagcgcaaaaacataacggtcactgccagccaccaacccggtgcacaacacgcacagcgcgcccaacgatagggtgccgttcttaactgttcctcaagcggtgcgaccttcacacagctgaacgcaacaagcctgacacagataacggtgcatcacgttagttaaacgatatttcgtgatattatcatcgtaggattatggccagtgcttctcaaacacaaaggattacgaatatgaacgacccattccttcctcctaacggacctttcgcggcagagccaagcctcggattcggtttcagccctggccctggcccggagttcagtttcagctttggcccgcgtcgccgcggcgacgcgggccgaggccgacgcggcgacgtgcgggcagccattctgatgctgctcaccgagcggccgatgcacggctaccaaatgatccaacaaatcgccgaacggagcaacggaatatggcggccaagccccggctcagtgtacccgacgctccagctgctctccgacaaaaacctgatcacggcaagtgcaaccgacggcagcaagaagcttttcgagctaaccgacgatggccgcgcggccgcgaaagttgagatgccgccgtgggaccagatcgcccaaggcatcaatcctggatacatcaacctacgaacagccatgaaccagctgttcggcgcggtcacgcaatctgcacacaccgccagcgccgaccaacaacagcgcatcatcgacaccatcaacaacgcacgacgcgagatctacggcatcctcggcgagaactgacctatcccgtgaacacaccatgaacaggccagccagactaacgtatcgttgtgcagaaaagtccactcaagccactcgacggaccaggtagcggacgcttcaacaaatgttgatagaactctacggcaatacagtcgagcgagccaaatgcttcatccgcaacagcgcgggactggagaagccggaagtgagggcacccacaaaaagtgccaccacttcccgtcgacagagattgaaccccggtcagcagtcctcatgcactacgtcaggacacatcgacccaatccaacgtccgctgcacggctttacgccaacccgcatacgccgcggcacgctggtcctcgccccacgtcggcgtccaacgcttatcctcttgccaattggcccgtagatctgacggaccagcccaaaacccgaccgctagacccgccgcataggcagagcccagcgcagtagtctcagcaactaccgagcgtaccacgtccacgcccagcacgtcggcctgaatctgcatgcacaagtcattactggtgataccaccatcgaccttcaagacatcaaggcgcacaccagaatctgctgccatcgcgtccaccacgtcccgactctgataacagatagcttccaacgtcgcgcgggccagatgcgcgttggtgttgaaccgtgatagccccacaattgcgcctcgtgcatcggaccgccaatacggggaaaacaacccggaaaatgccggtacgaagtacaccccgccattgtcaacgacctgacgggccagcgattcgctttgagcagcgccgctgatgatgcccaactgatcacgtaaccactgcaccgctgagccagtcaccgcgatcgaaccttcaagcgcgtagacgggtttggcatccccgaactgatagcaaacggtggtcaacaggccgttaccggatctcacgatagcctcaccggtgttaagcagcaaaaaattgccggtgccgtaagtgtttttcgcttcccccgcgtctagacacacctgaccaaccatcgccgcatgctgatcgcccaagactcctgtgatcggcacttcaccaccgacgggtccgtccgctaaagtgacaccgtagggctgcagcggtgaagacgacgcgatcgccggcaacatcgcccgagggatggaaaaaaacgacaacagctcgtcgtcccaatccagcttctctaagtccatcagcatggtccggctagcgttggtcacatcggtgacgtgtacgccaccccgcggaccaccggtcagattccacaataaccaggtatcgggggtgccgaagagtgcttcaccgttttcagcagcggcgcctaccccgtcgacgttctctaagatccattgcaatttcccgccggaaaaataggtcgccggcggcaacccggctttgcggcggatcacctctccgcggccatctcggtcaagcgcgaccgcgatacggtcagtgcgggtgtcttgccaaacgatcgcattgcaatacggccttccggtgttccgattccacaccagggtagtctcacgttggttagtaattccaagcgctgcaatatctttagctgacaaattagtggcgttcagcaccgacatcagcactgacgcggtgcgttcccaaatctcaacgggattatgttcgacccagccggagcggggcaagatttgctcgtgctcaagctggtggcgggccacctcagcaccattatgatcgaaaatcacgcagcgggtgctggtggtgccctggtcgatggcggctatgaattcagcgaactcggccaactgcgctccttcgacgtgaactgtgacacttcatggtccatgatggtctatcacccggcgtattccagctcaggtcagcctgtcatccttacgtgacagctggtaaaccttttgcatccgcaatgtggaagaagaagttaagcggcccacataaataagtataatcgcacacatcagcgtgaataccagcgcaagatgcggtagtattcaaacatcttcgaaacgaaacttgcggagtgcccagttcgatgccaactgggcacttacccgcatggaggtcgaatgtaaccttttcgccgctgactgctagccctccagatcgagccggtacgtgctggacgccagtgacgatcccgtctaccaaagcgaattatcattttacaacatcgaattcaatgctacactccgaccactgcctggacatacgagtctgggtctggagggcgaagtgcgcaccagcctgaacgatgctgaggccaagtcaaactccagtgtgacccatatcgtcatgatcggcatcttgccgacgctatctgatcgacagctggatgagctattcagtgcagtatacggccttcaagagtcggatcttcctcgcttactgttagagaaccggtgttgccagccagaactaaacgttgtttacatgtctgcgaattcagcatttcactacggcgcgctacacaacatgtccgaataggagcgtccactgtggaccaagatgggtttctttacagcacaggaaaatttctgcgagtctaccctagacagggtagatgcccagctgcaatggtcaagatgctgctacagtactgcaagtacatacatgccaacggccggtacacatctggaccaggtaaccgcgcataagttggaaactatgtaatcttgaagtaatgcactgagacagcgactaccgggggtagagccaattcgaggatctgcagccatagaatatggttgacccgcagcaagagttggctgtgttgataggcagcaagcaaattccgcaatgacgtgttgggtgctggctacgagtttgctgcgcgtcgttggcgctgatcgccgacgacaccgtgctagacatctatcccacacgcaccgcggtcgcgacagccaaaagggcagcccaggaacgcaggttggccaccaccagcttcgtacaggccgatatcactgcattgacttgctaatgacgggcggttcaatacggtggtcgactccacgctgttaccctcgttaccggtggagagtcgcgacgggtacttgagtccggtttaccacgtggggtcagcctcggacgtcagccattaagtgctggtgttcgccgagggtccgctttcccgccgagctggaaagcggacccaatgaagtcgacgagaccgaccacggcattgccaccggctgccactgcaacatcgccgcttgagcactcagcgcctgatagttgcttgtacgttacccgaaaacaacgccgccggggccaccgacaccaggccgctaacacccccgtagtcgaggccgcgacggccatattagcaacgctgatagccgagccaatacttgccaaatccttcgcggcgattgccacatatctctcgcccaactgtaatctacagtatccgtatctccctcgctcaatcgtcatcaacaattgtccaaagcgctatcgtatagagcccggacgggagaccactctaactttaactttttttgctgcggtattcagcggcatcagatagccggtggttgcgccctctaaaacctcgacgaagggaaactaccgatcgtcggcagtggtattgggccgtacggcgagatctgcaacaccggagcagccagccgcagaggaggtcgctccactgaagcggaggcgatcaaaatccgccgttcagctagcacagtcatgcccgcaccgcctgcggatcggcatcctcatccggagcaagtatagggatcgcacttggcttgtcgaccctcctcgaccacccgtcacccagcacacatcggccagcaccgtccggctgatgctgcctagcacggccaagtgtgcccgcacggtcaccggtccgcatgccaaatgttgacccagggctaccaaaacccaatcgcgcagtgatattggcctcgccaagctcgagttgctgggccatcgacagattcgtctacgcctacttcgagtcaccgcctcccagcaaccacagcttttcctgctgaccaatgtgcaccagatcccacgccagtgggctcatcaacagatcgtaatgccagccaagttcggcgtcgtcgaaatttactagccacaacgtcgagacatctaaggtacgggtgtcagatagtcggctagctgccctcctcaggacgtcacaaaccccttgggccgaccgcgccggactcgggaagctaacgtagccgcgatgtcgtacttgattgcccggtcggaaaagtcgtagccgggacagcgcccctgctcaaccttgcggaccagtcgttccatagtgccgttgaaactgtatcggagcgtttgcaacggcgacggacacacacactggttggtcgccacgtacaaccgccggtcacgcagaccgacccaagccgcggtgtcccaggcggtgatcaccgtttcaacggcctcagccacgatttcggcggcgggtcgggtcaagtcgtcgaggcagagccaacagaataaacgccagggcggcccagaaggtatccgatgagctatcaagatagcgaattttcagtcactgtcgtgggcagacctatgtgaacaaggtcgtcaagcgcataacctaggtcgacgacgatcggacggcggtagccgcggacaggaccaaagccttccgcccagctggcaaagagcgtaaatacgcgatcgcagtcaggtccgcaacgtccagattgtgcaccagcatcgccgacggctgagctcatagcgagcccagtcggtgcaggggataatcgccactggctccaggatgaggccgcagcgtgcggagtccacctggcccccacacccgctgccgggtgtagacccggccagagaattccccacacaagctatcgggaagttggcgacgataacgatatcccagttaacgccaggtcgtatactagccacatccgcaccgcccatccggcttgtggcccagcgtccacgttaacccgaactaaggcggccgacgtgatctcatcaccagcatccgtcacccgcgagtcgttggccgcgaagaactgttccgtcgcctattaacgcacaccggggttaacggactcagctggctgcaacgagttcgcgcccaggaaaaccagctccagatcggcgccggcaaaggccgaccacagcgcggcctggtcgtacttcgtcccatcgatcgcaaataccccggcgtcggccaactgaccgtacagttcgataccactaccgggttcgaccttcaccacgctacgcccggcagcgggctaagccactgcaaaaccgtaatatttccataccagcccggcctgcgctgcggatcggccgggtcgtaacgtgcggcttccattccgaaaacccatccggccccagcagcgcattgaccagaaaagccgtcagcaatttactgcggcagccaaacactagctatcggggtattataatactctccgggactgagcaaatctcgcggaccgcttgttacacagttatcggaacgaaagccgccaccctattttttcgtcatgcatagtgccccaacatattcggtatttcggtactttatggtcacccgccccgccgtacgtgggtacccacattctcccacgctattgacccagtgcgttctgcatcgccccggccagcacgttgaccgcaggaccggcgttgccaggttggcaaactttcgtctgcagcaacacgttttcacgcagccgggtttgtacgaaacaccgacgatcggttcccgcctcctgcttagtccaattcgcatcggcataggtcggcgtgccacccacaaacgaccagacctgggttgttccgttatccaggtgcatcgcagtggtctgtcccgagcaacctacggtccggtccacgacccgatgaaaggcccgtaccgcagcgtcattggtagcaaataccccgaccgcctgcttgacaaaatgcgtctggtcattagcggacgtctgggtaatagctccgttgaacgacgctaagtcaacatcatggtacacctcaggcaacccgatgtccgcccagttgttacacatcggtagatctaccgagtacgcctgcagcggctcggttaatagcgactcccaccccatgggtcgaccgatgatattgcccaccgagcccttgccgaggaccgcgtatgacaccactcccggttcagaggggcgcgcactcgcgacaggtacccccaggcccaaaccgacactcatcaccacaggctgatatccttatcacccagctcaccagcccagctgcaccatggccgagacatcgagaatgataaaagccatccactgacttccggcggtcatcgcggcggccgacagtcgctgtggattccgtgatgtaacggacttcgattgtcatggatctcgatcatgccagcccgacgctgcacagcgaatatcatcaagaactaccgtcctcagcggcgcacgacggatcgtcccgggtaccgccgtgagagttgagcacctagacccaagccggacggattcacggaaatcgcgaagcggcatggtaatctatcatttcgtaacgcgaccaccagcttcgataatcggaacgcgagtggccgtcacacactctcaaaactatacccttccacgcaaaactatacccttccacgcgggctgtgccaggccgggcaggtgcgccagactcaataatttctgttcgacgtcccgtacgagtaaacgctaaggccgtgctgaaaggcgtgctcgttagcgattgaccaggaccaccctgtgcccaaagtaccccggcatgacacacggatcgggaggtcccccagggtttgaacatgccgtgttcatagcggtaatggcagggatggtggagaccccacgatcacggcagccaagaagaacacgtcacggcgacgatagcgacccgggccggggttatagaagacctgggggttttgtaataatggcacctctgctccagggggcgccggtgctgttgcagtcgaagtccgcacggttgaggtttcagatgttccactcatgagacgcataatgccggagtaaacaatagtttcagcttggcgttacttgtgtagaagctgtgagcccccgcaacctcattacctggaacaaccgccaaagccacagcgctgccgggacggcggataccgaaattcagctgtccgatctgccatagtaggcgatgcgccggcacaagcatgaaataacgttgtttgtcttgtcggtggtctggcctatagcagcgaaccacaagccgaagtctcgtcgtctctccgtacgtaaggctgccgccaaggcgaccgtggctgccaacgaaaagactgaccggtctgtcggtcgatacccaagtgacgcaattcgccgaagcgcagctagactcctgagatcaggtaatggagtgcggaggcgtcaggatgtgttccagacacgtatggtggttttgactttgtgtcctctggcctccttggcgggcatctggtagcgtcgggcgaaggtgtaattcgcttcatggagtgcagcgaatccgcgaggtgggggtattttacccgcggaggtgattctttgtcggcagcagctggcccgcaatccaggttgtcatggcccgcaaacacgccatagcgagtcatcgaaagctgcgggccaggataagggtgcacaaccacgtccggggccctggctgggtttcggtggacaaactgatgtttccatggccgacctgatcatggtcggcgcagacctatccgggctgtgtgcggcccgtgcgctaatccaacaaggtaagtttctggaggcgcgtcatcgggtaggtggtcgaatggttcgcaagcctgtcatcagcggcggttaaattgacatcggcgatcaatctagcgggcccacccaaagcggtattctctcgctcgccgagtcactgggtgtcatgcatttcgattaccacgatgtgggacacacactatcgtctggtgcaatggccccttgtcgaccgtcgatggcagcttgccaccgaccaaaacatcaccagcaagctcgtcagccgacgttgctgaccgtcagcagctagctcgccgttaccaccacgccccggtttctccggtttctgtgttaccaactgaacactcgatcaagaaagcgtcgcgctggccattgtatcagtgctgtttattctcgcaccctacgcagcgagccccagcaagagaagaaaccagaatagtggctctttagaggagcggcaggtcagcaaactgattcaccaccggagcgcatacttcttgaacaacccaccctcctaatcgtgcaggacacccgcggagcgaccgtcactactagctatggtgatttactgaaagaactttgtgatagtcgcaattcctcatattttagtcggagcgattgattacagtccgccactacccactcgtcgtatccaatagctccaatgggatcggttatcaaatatgcctccatttacccgaggtgcacgaaagggctcagcagagcaactgtgagtgatcaaatcgtcgtacaaacagcatacagctcttagcctagaggtatcccaggaattttgattaacttcgtcgttgggcatgccaccagccggttaataaatgaatccgacgacacccataaaataaacagtaccctcggacctagccaggtatttcggcaaaaaagcgatgcgcccgatccaattcatcgaaacaaattagaccagtgagaaatggactgaagaagctttcaacgctgtattctaccccaatatatttaccacttacggcccagccatagccgaatctgtgggccatattcactgagctgatacgaaagtcccctaaatggacggcctattttgacgaggccatacagactggacacaccgcagctcatgcggtggcgggacgcgcagtctaggctcctgatcagggttttaacgggttgaccgcgaattggatcacccggtacagctcactcacccgtgcacgggtgtcccactggctaacgaagatccgcagttcatcgagggtggaaccgggtgagatgtacccgccatacggttgggcgagccgattgtcgtacggaggcggcaggctttccgccggatcgggccactcatcgtgttgcaccactgtagtcaccggggaggtgcccagcaacgtcgggtcggcggcaactcggacctccatattgccagtagtggcgttgaaataggacagcacggcctggccgcctatctgcttaatgcacatctcgccaaccttgtcaggccagagaggtgtcggaggcttgttccaaccaccatcaggtccagccgcccaaccctgccaccgagaccggtcggtgaacgtttgcggtgtgacccggaagagctgcacggaatctctgcgggtgaaactgttggccacgatgtacacccacccgctcgacgagtcgggggtagggatcggatcgtagtacccgctgatctgggtctgccggctgtcctgggaggtcgcggcgcgtcgcgatcctgggacagtctgccaaccgacacgcgcgggctcagccgtgaccagccgtgagtcctgtggctccaggtttttggtcgtagtcaccatcaggtagttgtgccggttgatctgcaccacgccagcaggcagctgtgaatctcccggaggtgcggggtcggccagcaacggcttatcgacaccggtgacgccgatgtaacgcaccccggtcgggtcgtcgactgacgcagtgtccacgtgcagggcgaccggtgagtaccaaccaccgaaacctaccccctggccagcaaagctgtcaccacaaatctgcaaaagctcggcggggaactcgatgaactcgcacaagtcggtggcgccgatgccgtagtcaccggtgcgggttcctgtgcccgccatcggaccgatccgcaacacttgacccggcaccagcggctgcagaatcggctctggtactggcgcgggtggatcggcatgcgctatccaagaagcaaccgaaaaagcctgtgcgacaaacaaacacaaagcggcataccacgagcactccacgagccgggcaaaactcacccgtggatcatagctgcgtggctagcaactcggcgatctggatcgcattgagcgccgcgcctttgcgcaaattatcaccagagacgaacagtgccaagccacgcccgtcgggtacccccgggtcgcgccggatgcggccgaccagtgattcgtcgacaccagcggaagccaacggcgtcggcacatcgaccagcttcacgcccggagcaccgcccagcaggtcgcgggctcgttgcggcgacagtggccgggcgaattcggcattgatcgacagcgaatgcccagtgaacaccggaacccgaacacaggtaccgctaaccaataggtcgggaatgcccagaatcttgcagctctcaaagcgcagcttctggtcctcatccgtctctcctgagtcgtcgtccaccagcgatccggccaggggcaccacgttgaaggctatcggcgctacatacttgctgggcgcggggaattgcacgacaccaccgtcgtgtattagttgctcagcaacgtcgataaccgcacgcacctgagcggccagctcggctaccccagccagaccactgccagagaccgcttgatacgacgacaccaccatgcgcaacaactgagcttcgtcgtgcagcaccttgagcaccggcatcgagaccatggtggtgcagttggggttagcaatgatgcccttgggcagcggaaaagcgtcccggacatccctgttgtagttcacctcggacaccaccagcggcacttgcgcatccctgcgccacgccgacgaattgtcgattaccgtcactccagcggcggcgaagcgcggcgcctgcacccgagacatggatgcaccggcagagaacaacgcgatgtctagaccggtggggtcggccgtctcagcgtcttccacctcgattttctgaccgcggaaggccaacttacgaccctgcgaccgagctgaggcaaaaaaacgcacggaatcggcccggaaatcgcgctgttcgagcagtgtgcgcatcacgtggccgacttggccagtggcacccactaccccgattgccaaacctctggtagccattacctccccgtccccgcgtacaccgtcacctcgtcctcgccaccgagtccaaacgcctcatgcaacgcaaagacggccttgtctagttcggtatcgcggcacagcaccgatatccggatttccgaggtggagatgagctcgatgttgaccccaacagcagccagcgcttcgcagaaggtcgccgtgaccccagggtgactgcgcatgccggctccgatcaacgataccttgccgatgtgatcgtcatagagcagctgggtgaagccgatctcgtctctgagcgagcccagcttggccaccgcgatgggcccgctatcgcgggagcaggtgaaagtgatatcggtcttgccgtcttcgaccttggatacgttttgcaacaccatatcaatgttcacatcagcgtcggcgacagcgcgaaacactttggccgcgtaacccgggatgtcgggtatcccgacgatggtcaccttggcctcgctgcgatcgtgcgcaactccggtcaggatggggtcttccataggtacgtccttgatcgatccaacgatgacggtgcctggtttgtccgcatacgacgatcggacgtgcaccggaatgttgtggcggcgtgcgtattccacgcagcgcaacataagcaccttagcgccgcaagccgccatctcgagcatctcctcgaaggtcacggtgtcgagcttgcgggcgttgtgcacgacccgtgggtcggcgctgaagataccgtccacgtcggtgtagatctcgcatacatcggcgcctaatgccgcggccatggcaattgcggtggtgtccgagccgccgcgacccagcgtggtgatatcgcgggtgtcttggctgacgccctggaatccggcgaccaacacaattcgcccctcgtcgagcgcgaactgcagccgggtcggggtgacatcgatgattttggcgttgccgtgggtgccggtggtgataacgccagcttgcgaaccggtgaacgagcgtgcctgggcaccgaatgattcgatagccatggccaccagcgcattggagatgcgctcccccgcggtcagcagcatgtccaactcgcgggccggcggctccgggcatacctgctgcgctaggtctagcaggtcgtcggtggtgtcgcccattgcggaaaccaccacaacgatgtcattgccctgttttttggtctgaacgatgcgctcagcaacacggcgaatccgatcggcgtcggccaccgaggatccaccatacttctgcacgacaagcgccactgttgcactgcctttctggttatatacctgcctttctggttatatacctggctagttaggtccaaaacagaatacgtggggctggcactgcgacgatgcacaccaatgcgtcgagcaccggtcgctttaccggcacctagcagcggatgaaagccagcatagttatgtagcaagctggcgatgtcaacaagattggccggctgagcctgaaaccccttttagaacctattaaatttaatcgacgtactatcaggttacttgagcggaaaatctacagacaccccggcgaccacgatacgtcgccgattctctggtggcgggaaatcgccagatcctgcttggcggggacgcagcacatgtcgtttgtggtcacggcccggagttagtgctggcagcggcacaggatttacagggtatcggctcgtcggtgtgcgcggcacaggggtaacgccgacaccaacgagcgactgtaaggcaagctgatccgaccccagtgcctacggctcagacctggtgcacagaccgaagctcagcctgtaattttggcagcgacgccgatcgcagtatagttcagatcgtgcagcaggtactcctcctcgaacgccgcgacggggtctgatcccagaccggctgcccgttgtggaagttcactatgcgccggtctgaggttccttctcacatcccggagcaattattgtggccagcttttctgagtctttgagccaggatccagcagatgcctataaatcggcaccctccatcaccaaacccatgggcccgcccagtcccggccaaccccagtggaatccccaacgagctacatcgatgccagtcttccggtaccggccgttcgccaaggaagtcgagcctatccggcagttgaccgcacctggcccgaccgcgtcattgattgcgcgcctctgtggtgtgcggtggatctgcgggacggcaaccaagcgctgatcgacccgatgagcccaatctgcaaacgccgcatgttcgacctgctggttcgcatgggctacaaggagatcgaggtcggattcccgtcggccagccagactgacttcgacttcgtccgcgagatcatcaccgacggcactattccggacgacgtcaccatccaggttctgacccaatgccgaccggaactgattgagcgcaccttcgaagcctgcgaaaacgcgtcgcgggttatagtgcacttctacaactcaacgtcaattctgcagcgccgcgtggtttttcgcgccgaccaagccacggtaaaggctatcgcgaccgacggtgctcgtaagtgtgtcgaagaggcgttcaagtacccgggcacgcactggcgattcgagtattcaccggaatcctataccgggaccgagctggaatacgccaaacaggtgtgcgacgccgtcggtgaagtcattcaaccgacaccggacaacccgatcatctttaacctgcctgccaccgtggagatggccacccccaatgtctacgctgactcgatcgagtggatgagccgcaatctggccaaccgagagtccgtcatcctgagcctgcatccacacaacgaccgcggaaccgctgtcgccgcagccgaattgggctatcacgccggtgccgacagaatcgagggctgcctgttcggcaacggggaacgcaccggcaacgtgtgcctggtaacgttgggactgaacctgttttcccgcggtgtggatccccagatcgacttctccaatatcgatgagatccggcgaacggtggagtactgcaacaagctgcgggtgcacgaacgtcacccctacgggggagacctcgtgtacaccgcgttctctggcagccaccaggatgccatcaacaagggcctggaccagatgaagatcgatgcggacgccgccgactccgatgtcgacgacatcctgtggcaagtaccgtacctgccgatcgacccgcgcgacgtcggccgcacctacgaggcggtgatccgggtcaactcgcagtctggtaagggcggcgtggcttacatcatgaaggccgaccacggtcttgaactgccgcgacggctgcagatcgagttttctcgagcgatccagaaaatcagtgagggcgaaggaggcgagatcacacccacggagatgtgggacgtgttcttcgaggagtacctctcaccggtgcagccgctggaacgcataaagcagcgggtcaatgccgcagaggaagacggcggcagcaccagtattgccgctaccgtcaagatcaacggtgaagagaccgaaatcagcggagtcggcaacggcccactggccgctttcatcgacgcactgggccacgtcggcttgcaggtagccgttctggattattccgaacacgcgatgaacgccggcgacgacgcgcaggctgctgcttacgtcgaggcatcggtacatgggcacacagcatggggtgtgggcattgcaccgtcgatcaccacagcgtcgctacgtgccgtcgtctcagcggtcaacagggcaatgccccgctaggactttagtcagagacaccgtcctcggcggcacctccccgcccaaggctccatttgtcatcggcgtgcctggcccatccgggccagtcggtctgctcggcgaaaaaaagtatatcggacacgagcggcctcagcagcaggctgactccgggttatctaactcatcaaaaaacagcgtgaattactcgtcggtagcctcggcgctagtgaattcattcaggaaaatactacagatgacagcgcgaacgtagtccatgaattactacccagaaaccaccggcacacccaattgcctggcgagataacctttgccctgcgcgggagcggcttcgttgcaaatcaccagcgacgtttcacggtcaacggcctcacagtaggccagcccggcgtgcaggattcacccgacgagttcctcgtgggtacgtgccaactcggccgccaggtccacccgcatgccctgggccagcgatctacctcgccaacggtatctccccaggttgagatacggacacgacatacgggcaaccagcgcctttaacggtcgcagcccgtcgtgagccagccggccgttgggccagcggcgccgagtcaccggaagtcacacgtcgagttggcgcacccgcttgagcgccacagccagcaccccggtcaaaaaaccattgcctcgtcgaaggcatgatgcgaccgtttctggaggatgccccagtgcaccacgaatgtttccaagagcagattatccgatcctcaggcctagccgccggaccagctagatcgtgcacatggcactgtcgacgaggagttcggctccaggatctcggcctccgcggcgaaaaatgcgtaggcaaacgcagcattgtgcgccaccagcgtgcggccgagcaacatctcggacacgtcaccgacaatgccggtaaattgaagctgaccttcgagagcatgacggccgtcaggccatgtacgtgggtgggacccgatattgagcaggctgaccagggaccactccacgcgtctgtcgacatcgaggccgagtatagcaaggctgattatccgggtcagacccggacgaaaacccgacggctcgacctgtcctacgaggactgcccaacccgcgttcggctcgctggctgaccccaaagcgtcgggttcgttaactgcaggattgcatgtccagtcgacatcaccaatgtcgttgcacgtcgtgtaggcctgccactatatgagggcgacccgctgcacccagcgcaagcgccgcgcttacgatcgccctaaactgcacgggtgtttaccgtccgcgcacgtctagcctggccgccggagcaagcgcgcggtggacatcacgcattaccggacgcggagctgggacaatgatcggcggcctggtagcgataaccttggaccgctcaattctcagccagctgggagcgggccggcgcaccatcgtcgtcaccggcaccaacggcaaatcaacgaccacccggatgactgtggatgcgttgagcacactggcccctggctcagtggcgaccaatgctgaaggcgccaacatggacgctggcctagtggccgcgctagctgcgaatcgtgccgccacactcgcagtactcgaggtcgacgagatgcatgtgccgcgcgtcgccgatgccctcacgcctcacatcgtcgtactgctcaacctgtctcgtgatcagctggaccgcgtgggcgagatcaacgtgatcgaacgcacgctgcgcaccggcctggcccggcacccgacggcagtcgtcatcgccaattgcgacgacgtgctgatgacctcagtcgcctacgacagtccgaacgtggtttgggtggccgcgggcggcacctggtcgaacgactcagtcagctgcccccgcagcggcgaagtcatcgtccgcaaaaatagacattggtattccaccggcgctgatttcaagcgacccagcccacactggtggttcgacgacaacaccctgtatgggcccgatgagttggcgctgccgatgcggctggcgctgcccggctcggtgaatcgcggcaacgccgcccaggcggtggccactgctgtcatgctaggtgccgacgccacaacagcagtagcagcagtgtccaaggtcgacgaagtcgccggacgataccggagcgtacggatcggcgaacacaccacccggatcttgctggctaagaatccggcgggctggcaggaggcgctgtcgatggtggacacacaggccgccggggtggtcatctcgatcaacgggcaggtacccgacggcaaggacctgtcgtggttgtgggatgtgcgtttcgaacacttcgagaagattcccgtggtagccgctggcgaacgcggcaccgacctagctgtgcgcctgagatatgcaggcgtggaacacactctggtgcacgacaccgtagccgcgatcgcctcgtgcccacccgggcaggtggaggtcgtcgccaactacaccgcgttccgtcagctacaacgcaggttggcgcgtcatggctgactcgacagtgcggatcgggctggtgttgcccgacgtcatgggcacctatggcgacggcggcaacgccgtggtgctgcgacaacggttgccgttgcgaggcatcgctgccgaaattgtcgagctgacgctcgccgatccggtgcccgagtcgctggacctgtacacgctaggcggcgcggaggactacgcacagcggctggccacaagacacctgctgcggtatccgggcctgcagcatgcagccagttacggcgcacccgtgctagcgatttgtgcggctgtacaagtgctcggccaatggtacgagacagcgtctagggaacgagtcgacggggtgggtttgctggatgtgactaccgcaccgcaagatgtgcgcaccataggcgaactggtcagcacgccgttgctgaccagcttgaaccaacgcctgagcggcttcgaaaaccaccgcggtggcaccgtgctcggcccagctgcgacgccactaggcgcagtggtcaagggagcgggtaaccgagttggtgaccacttcgacggcgtcattcagggcagtgtgatggctacctacatgcacggaccatgtctggcccgtaaccccgaacttgccgacctactgttgagtaaagtggtaggtgagctggcgccactagagctacccgaggtggagttgctgcgccgcgagcgactggcggctcgttaggccctccaacccctggcgagcagcgtgttgggccccgaaccaacacttcgttggatttgtttggatttgtcttgggaaattacgtcgtaatgacccaagttaagtcttccaacttgcgtagccatcgctggacgcaggtatattgcggacaatcgctgtgatggtggtcaacgccatattcaacgtccaccttgtaccccgcccagcccataatcaaatacgcctatcggacgtcagttctcctgcaccggttgcccggtggaaacgggcaggttgacgtcgatcaaccacaaacgcaaccaagtctctttgggggaagcggcgcccggatagacgagcgcaaacgccgcgcgcagccgtcgtgtatccgagtaccgcttggcaaagaacagcacattttcgcacgaaaacagggtctacccgcatgagagcgtcgagccgcgccaccgcctgccagcgtagcagatgccgaccgcggtcatacgccgtgctggccaacgtagtgacgggcagccccggggggccgacacggttgatctggtcgtcggccacggcctcgctgcaagacgataaggccgcgttgtggccgggtgctgggcccgatcaattcgacagcaaagccgtcgtccacccactgcgcacaatcaatcgaggaagcagcggcgccggcaaggacagcctttgaccgcacgaggccagccagacgccggtaacgcagccgcgcagcgtgggtgccagaacacctcggcacgtaaatgccggggtagatcgcgtaatgccagtgctgaagttcatatatggccatccgaccagcgttaatgacctcacatgctaataaagacgttccgcatgacaagcatgctaacaccgccatcgacattccccagatcgacgttttgcagataaaacccgagaaagcacctgcaaacgtcgatttcggcgaaacgccgaaatcagaccatcgttcgccggccggtcagcgcacggccgagtgtcagctcgtcggcgaattccaggtcgccgcccatcggcaagccggacgcgatccgcgtcacggtcaagccgggcatatcgcgcagcatccgaaccaaataggtggcggttgcctcaccctcggtattggggtcggtggcaatgatcacctctgtaatgcccacatcgtcgacccgctcaccgatgcggcttagcaactcgcggatccgcagctgctcgggaccaattccggatagcggatcaagcgcaccgcccaacacgtgatagcggccgcggaattcgcgggtgcgctccacggcctggacatctttcggttcctcaaccacgcacaccacagatgcatctcgacgggtatcagaacaaattctgcatcgctcgtcgtcagatacattgccgcacaccgtacagaaccgcacgtcatcgcgaacctttaccaacacggctgtcaaccggtcgatatcttgcggttccactgataacaggtgaaaggcgatgcgctgcgcgcttttaggtccaataccaggcagcttgccaagctcgtcaatcagattctggaccggcccctcaaacacgtcgatgcaattcaggttcctgccatgtaagtcggtggggtcggtggcggtgccgtcggacgcatggcgctggtcaacgctcccaaacgctcctgagccagtttggtgacttgcttagaagcatcagccatcgcgccgacgatcaggtcctgcaaggtctcaatatcgccagggtcgacgactttaggatcgatagcgacactaaccacttctccactgcctttgacgacgacctcgaccaagcccccaccaccctgaccatgcacctgcgcgttcgcgagctgttgttgggtttccagtagcttctgctgcatctgctgcgcctgggcgagcagcgccgacatatcacctccgggttgcatgacagctccctcgcatcttggtctcgaattggtttcgcctacagatattagggcgatttgaaatttcgagtttagactgcaccaggctatctttgcgccgtgaacacacgagttagcctccgtatcgggttccgaatggtcgtaggcctattagtagcggccttaacgacaatcaccccgaccgcggtagcctatccctctaatcccgccaatatagctggcatgatcgtgttcatcgatcctggccacaacggctccaatgacgcatccatcagccgtcaggtacccaccggtcgtggcggcaccaaagactgccaggccagcggcacgtcgacgaacagtggctatccggagcacacctttacctgggacaccgcactgcaggtgcgcgccgcgttggacggcctgggtgtgcggaccgccctgtcacgcggagacgacactgggctgggtccgtgcgtagacgcacgggccaacatggccaatgcgttgcaccccaatgcctccgtcagcctgcacggcgacggaggtccggcgtccggtcggggctttcacgtcatctattctgccccgccgctcaacccggtgcaggccgggccatcggtgcagttcgcccgaatcatgcgcgaccagctacaggcctcgggcattcctccggctaactacattggccagagcggtctgtgcggacgctcagatttggctggcctgaatctggcacaatattcgtcgatcctgatcgagttgggcaacatgaagaatccagcggactcggcactaatggagtcgtcagaaggcaggaagaaatacgccgacgccgtggtccgcggcgtcgagggcttccttgccacccagagccgagcgcgctgaactcccgccgtgggactagcgctccagctcgttcttcaggttagctaacacctcggcctggatcttcttaagccccagcggcgcaaaggtcttttcaaaaaagcctttgacaccgcccgcaccggtccaggccgtcttcatcgtcacgctggatcccggtcccgcaggagcaaccgtccagctagttaccatcgacgagttcgcatccttctcaatgacggtgtggccagcgacatcaacgttgacctgcacatcgcgaacacgtgatctggtgacctgcaacttccacttcacgacggtgcccggcccttgaccgccctgcaccacctgatactcgttatactgcggtgataaaattttcgggcgcatcttctgatagtccgctaccgcagcaagcgtggctacgggctcaacattgaccaagattgtgctgactgcgctcaccggtcccattaggcgcgactcctctgttgtgattacgatgccccgcacttggccattaagaccggttcggggattgtggtcggagactaggatatatatggtgtctgtccaagaatctgcactggttgtctacacatctggcgtcaagcggttggtggcgagctatagatctatccccgccacgtcgcccgtacgactcgccaagcccacctcaaacctgttccgcacccgtgctaaacgcgatgcacccggcttggatgcatcggggctgaccggtgtcataggtatcgacaccgaagctcgcaccgccgacgtggccggtatgtgcacctacgaggacctggtagccgcaaccttgccttacggtcttttgccactggtggttccgcaactcaagactatcaccctcggcggtgcagtcaccgggctgggcatcgaatcggcctcgtttcgcaatggcttaccacacgaatcggtgctggaaatggatatcctcaccggcgctggagaattgctcacagtatctgcaaaccagcacggcgacctgtaccgtgccttccccaattcctatggtacgttaggatattcaacacggtttcggatctccctggaacctgtaaccccctttgtagcactgcgacacatccgatttcacttgttgaccgagatggtcacggcgatggaaaacatcatcgacaccggcggacacgatggcgtcccagtcgattatctggacggtgtggtgttcagtgctaacgaaagctacctatgcatcggtaaacggaccacaaccccgggacctgtcagcgactacaccggacaacacatctactaccggtcgatccaacacgataacgaagttaaagaagaccggttgacgatccacgactacgtgtggcgctgggacaccgactggttttggtgctctcgcgcatttggcgcgcagaaccagcaactgcggcgctggtggccgcgacgctaccggcgtagtagcgtgtattggaagctgatggctgccgaccgacgctttggcatcgttgaccggatcgaggcgcgcaatggccgtccactgcgagagcgggtggtgcaggacgtcgagctgccgatcgaacggacctgcgagttcttggagtggttcctaggcagtgtgcccattgctccgatctggttgtgcccgttgcggcttcgcgaccacaacagttggccgctgtatccgatccaaccggaccacagctacgtcaacgttgggttctggtcctcggtgccggctggcgccaccgagggtgagaccaataggacaatcgaggccaaggtcagtgcgctcgatgggcacaagtcgttgtattccgattccttttatacccgtgaggaatttaacgagctttacggcggagagtcctacaatgctgtgaagaaaatatatgaccctgattcacgtctccttgacctttatgcaaaggtggtgcaacgacgatgaccacaaccaaagattccgagcgtttcacccaaatttctagtggcaaactgaccatggccgaaattctggggatcttgaccgcaactgggcaacaaccgctgaaattcaccgcatatgacggcagcaccgcaggccacgatgatgccgaaataggtctggatctatgcagcccccgcggcgccacctacttggccacggctcccggtgaactcggtattgcgcgcgcatatgtagccggtgacctgcaggcccgcggtgtccatcccggtgatccctacacgctgctcaaaacactgaccgacagagtccaattcaaacgtccgtcactgcgcgtactagccagtgtcgtccgctcgcttggtgttgagcatttgctgccaatcgcaccgcctccgcaggagacaccgcctcggtggcgccggatcactgacggcctgctgcacagcaagactcgtgacgccgaggccatccgccatcactacgacgtttccaaccggttctacgaatgggtgctcggaccctcaatgacatacacttgcgcagtttatccgaatgccgaagcgacgttagaggaggcacaggagaacaaatacaggctgattttcgagaagctgcggctgcagcccggtgacaggctgctcgatgtcggctgcggctggggcggcatggtgcgctacgccgcccgccgcggggtccgggtcatcggtgcgacgctgtcagccgaacaagcgaagtgggctcggaaagcgattgacaacgaagggttggcagagatagcacaagtgcggtattccgactatcgtgacatacgagagacggaattcgacgccgtttcgtcaatcggactgaccgagcacatcggtgtcaagaattaccccgcctacttcaactttctgaagttgaagttgcgcactggcggcttgctacttaatcactgcataacccgacgcgacaacaagtcgacctcctttgccggtggatttaccgaccgttacgtcttccccgacggggagctaacaggctcgggacgcattaccaccgaaatccaagaggtcggtttagaagtgctgcacgaagagaacttccgccatcactacgcgatgacactgcgcgactggtgccacaacctggtcgagcattgggaagacgccgttgccgaagtcggcctacccatagccaaggtctggggtttgtatatggcggcgtcgcgtgtggcttttgaacaaaacaacctccagctgcatcacatactggcgacaaaggttgacgtctggggtgacaacagcctaccgacacggccttggtggacaccttagtcttcaaccgcgtcagtcagccatttatcgatacggcgggcacccagttcgttttgcaacagttcgagcgcaacctcttccaggtcgggacgcggtgctgacaggtctctacgcccgggttcagctagcatgccctcatcttcatactgctgggcagaagccacgtcaaggacaggaactttctcctgggtaggcagcgcaaccattccctcgcaagcgggtagtgcacccacagcaggcacgggtacgccggcctcgcatcgcacccgccagttcacacccagcgcgtctttgagcgcttcggcgataacatctacgttgtgctgttcagacagccgcttggccagtggcgccgatccgtgggtcaaaatcaaggtgttgtcctcaaccgcgcggacggtcgcgcccgccagcatcacctcggtagtgcggctgcgtggcgcaccttctcacgcaccgtcgaccacatggttcgtaccgcggccgcattgggtgcacccatgccaggggttggttcagcggcagcctgtggcgtagccagtttggaagactgagcatccggagcgggctgggaatccggggaagccaggaaaggctggtgagggagactaggttgggcagccttctcggcgggcgctgactgaagcgggtatgctgccctggcagcggggatcgacatgttcagccgggtctcgattcgctcgacccgttgcagcaatgccgactcggcgtccgtggccgaaggcagcaacagccgcgcgcaaaccacttcgagaagcagacgcggcgccgttgcaccacgcatctcccccaacccggagtgtaccacctcggcgtaacgggtcaacgtcgccggtccgattcggacagcttgctcccgcatccggtctaacacatcctccgaagcatccaccacaccacgggctgccgctcaggaaccgcctgcaggacgatgagatcgcggaatcgctctagcaaatcagtagcaaaacgccgtggatcgtggccggcatcaatcaccgattcgaccgcaccaaacaatgctgccgcatcgtgagccccgagtgcatcgacagcgtcgtctataagtccaacgtcggtggcacctagcaacttcagcgcccgctggtaggtcacgtgctcgccttccgcgccagccaccagctgatccaacactgacagcgtgtcccggggggaacctccaccggcccggatgaccagag

SEQ ID NO: 24 - DNA (genomic), 38494 bp, MYCOBACTERIUM LEPRAE; double-stranded, circular
  hypothetical: NO
  anti-sense: NO
ggaaccatgtgagcgtttggcggtccagattgcgacgtattcgaacacaccggtttggcgtagcacactgacgatgatcatcatgcttaacagcaaaaagatgacttcccaatcgattccggtttcatgggagtagaagacgtcttcggaattgataatgggcaaagtgaccacgatcgccgcgcccgtcagggccgccagcgtcttgttgacccgatcgctggcgattagtgcataggtgacgatgaacacggtgatcgcaatgacactcatctagcttcctgcgctgctgtcagccggtgacttgtcactgcatcggtcgggatcaatgtttcagggccgctcttagaaggcgcgatgctgtgatcacaccgagcagttgtccgcctttgaccacagcgagtagaggacttcgctgccgtgacatggtggcggccacttcgatgatggtatcgtcggcgttgactggggaaacgttgacaaggtggtccggtaaaacatcgcggactttcttgctgctcaacttttccgccgcctggtcggccgtcgactcgttgagcacgccagccagcgagggatcatcctggatataccggggcacaatgaatcgcaccacctgggatgcgggcagcactgcgtagggcttgtcagacatatcggtgaccaagagtccaggcaggccgtgctccgcaagcatacgagcagcgtccagtgcgctcgaattgatgctgattgccgggaagtcttcggcgatgtcctcggcgagcatgctatgacgatacgtctgtgtggttcgtggagtgtgggcgacatcgaggcgaactatatgatgtattccaggattgcaggacactgctgtcgaccagtattcgtgactcaccgcagactgacgctaccaaagcggtggctcggttatccgtttggtgcccccacccttgcgttacctgagtacaataacggaatgctggaacagatccgcaggcccgctgatctgcagcatctttctcagcagcagctacgggatctggctgccgagatccgtgagctcctcgttcacaaggtggcggccaccgggggacacttggggccgaacctgggtgttgtcgaactcacgctggcgttgcaccgagtgttcgactcaccgcatgatccgattatcttcgacaccggtcaccaggcgtacgtccacaaaatgttgacgggacgctgtcaggacttcgacagtctgcgtaaaaaggccgggttgtcggggtacccgtctcgcgccgagagcgaacacgactgggtggagtccagccacgccagcacggcgttatcgtacgccgacggtctggctaaggcattcgagctggccggaaaccgcaaccgacacgtagtcgcggtggttggggacggcgcgcttaccggtggtatgtgctgggaggcgcttaacaatatcgcagcaacaccgcgtccggtggtcatcgtagtcaatgacaatggtcgcagttacgcgcccacgattggcggtgtagccgatcacctcgccacgctgcggctgcagccggcctacgagcggctacttgagaaggggcgtgatgcacttcactctttgccgctgataggccagatcgcttaccgtttcatgcacagtgtcaaagccggtatcaaggattccctatcgccgcagctgctgttcaccgatctcgggctaaagtatgttggcccggttgatggtcacgatgaacatgcggtagaggtcgcgttgcgtaaggcccgcggcttcggtggcccggtgatcgtgcacgtcgtcacccgcaagggtatgggctatcccccggccgaagccgatcaagccgaacagatgcacacctgcggcgtgatggacccgacgaccgggcaacccaccaagattgctgctcctgactggacggcgatcttttccgatgccctcatcggttatgctatgaagcgacgtgacattgtggctattaccgcggctatgccgggccctaccggtctaacagcgttcggtcagtgttttccggatcggttgttcgatgtcgggatcgctgagcaacacgcgatgacgtcggcggccgggttggctatgggcaggatgcacccggtggtggcgatctattcgacatttctcaaccgggcgttcgaccagatcatgatggacgtggcgctacacaagttgcctgttaccatggtgattgaccgggctggcattaccggttcggacggccccagtcataacggcatgtgggatttgtcgatgctaggcatcgtaccggggatgcgagtggccgcgcctcgagacgccattcggttgcgcgaagaactcggtgaggcgcttgacgtcgacgacggtccgacggcgatacgattccccaaaggagatgtgtgtgaagatattccggctttgaagcgccgatcgggcgtggacgtactcgcggtgccggctacggggttggcccaggacgtgctgctggtgggggtcggcgtttttgcgtcgatggcgttggcggtggccaagcggctgcacaaccagggaatcggcgtaacagtgattgacccacgttgggtgttgccggtgtgcgacggtgttctcgaactggcgcatacccacaaactgatcgtcacgctggaggacaacggggtcaatggcggtgtaggcgcagccgtatctaccgcgctgcgtcaagtggagattgacacaccttgccgcgatgttggattgccgcaggagttctacgatcatgcttcgcggagtgaggtgttggccgatttggggctgaccgaccaagacgtcgcccgtcggatcaccggctgggttgttgcattcggccattgcggttccggtgacgatgcaggtcagtacggtccgcggagcagccaaaccatgtagcttgggcctggcgacgatccggatcgtcagattcattttcgtatcaaaactattgacgtaagaatacactatttcccactggatccgcgcaatgtgggctttccttcagtgcggaattatcgttacggtctttcgcagaagaccgtgctcctgttaggttgctggaataccggtacgagtgctaattcccgatgaccttgaaagcgcgagattagcgatgtgtgcaggaccgtgctatccgctgataatttggcgccagaccaatgttgagtgcgacctgaacattagttcctgggggagataggtgaaggtttctgagtcggatttatttgtcgctggatttaccactcgtctttccgtatggcgacatgcactgtgtcacctgaaagagagagcacatgaaaaccgtcaaagtcagccaaaactcacgttgttattgccggggatgggatctctgttatgactgtggctatgattcttacctgagtcggcgtgcggatcacgttatgctaagcagcacctgaagccagaggtaaggtcgagaatctgcgccgccaagacgataacccgatcgagcacagtttgcaaatgtattggttctattaccaaaccctgctaaagttactctcaactcataaccacggataacggcatgaccgtgctcgccaatctggttggcgtgagtgtagccgtgtttttttacgggcacctcatcattgatcggcattcacgcggaaggtgcgtaaggtattcgaaccacttcaaccactggggctggatcgcattgcgcagaacagtgctcattgtcggtctggactaccaaggagtggtgtcccctacgggtcatcccaattttgatgctcaatatgtacctgttgtggatgtgctgcgagtgactcgttgcggagctgagcaccatttcatatgcagactatatgcaactgaatcgctagtcccccaggtgaagaagttttttccgagttgccgaacattttctttgcggcgtgtccggacgcaccagcagcgattgcaggccgggttcttaatgagctgtttaattttacgagtcgaccaacgtacctaaactaggtaacgccgccttccagttatgattatttatggggaccgacgaacgcataatcgagccttgtattcatcactaatactcatgtcaaaataaattttgacatgagtattagtgatgtcgagttcgagaatggtcggataaccggattgctatcggcctatggctgcatttttagttgcgactatgccattatctccttgctttatctgacattgctctaaatggtcacatcagatcacgtaaagcaaaatttactcacctaacgcactggcatacaattgcaatagattcatcgagcgggatccagtttttctacgtgagatcctggcaacatggtagtcatttattcgtcccggagtctttactgtgtgtttggacagtgagtagttccacggtctctgtggttcggggcgcgggcttctggagaaatgttcgcttgccgtagggaagtaaagtactttttatcgatagcctggagtgattgtataggtctggttggggtatttatcgaccggtaagcgaatgcacactagatgagatcttgactgagtgcttggcgcagtgcgacttcgatgatcggtcgcagattcgggctgaaagaacgattacaagctgatgcaggttaagcgaggtcgactacaaaacgttggtgggcgatctaccgccgcgtcttgccttggctcctgcgtgtggtatgcgcatggtcaatctattcgccataccgatgccgggtgctcaccatcgatcgcgtcgtattcgcacagaagtgcctaacctcatatttttgccgataaagtgggcctattcaccggagctgattttgtttgttctcaccatgcagacggcggcatgctccggctatttggccgccagccaggcgttcaacgttgcagctctgcacgctgtgtctgacttgcaatggacttgcgagatcctgtcccatttgttgtgctgcggctgtgaggatcgatgtggtggtggaaacgccaccgtacgacgctcacacatgagcgttagccagccgacgacttcaccgccgaggccagaatggtcaccacgagttctcgctgccacgctcgcgcttggccgacacgcaaatattcctcgactgcattgaccgggtcgaccgagctttccggcagaacctcccagtcccagcacagtcgtcgcaccagttcaggcgagacgagattttccgtcggtaccccaacccgctgcgacaccgtcgccagtgccgctctggccgcctccagccgtgcagcggcatctggtttgcgccgggcccaccgcccgggcggtggtggcacgttggacggctcggcttcgtccggtaggtcttggctctgtcgtgccgtttccagcgctgccaaccacatcgcagcgctgcgacgctgattggccccgccgaaaaccggcattgcgatcagctcgtcgatcgtcttggggtcggctatggctgcgtcgatgatggcggtatcaggcaggatgcgacgtggtgcgatatcgcgacgttgggcaatgtggtcgcgcgttgcccacaattcgcgaacggcggccagggctcgccggtcgcgcacccgacggatgcctgacgtgcgtcgccagcggtcccgacgggtgggtgggatagtctcggtggtggcccccctagttgcataggtccgcaggtagttgaattcctgcgttgcccaatcagttttgtcttgctcggccagcaccttcgagattgccgtgcgcagttcgatcagcagctccacgtctagagccgcatagttgagccagtccgaaggcagcgggcgtttcgaccaatcggcagcaccgtggcctttggccaactcgaaacccagcagccgctgaaccattgttgcgaggttcaccctgtcaaatccggccaggcgtccggcaagttcggtgtcatacaacgctggcggccgcatgccgacttcggccagacacggcagatcctgatcagccgaatgcaggatccattcgtctttgctgatcacctcggcgacgggtcgcagcgcggtcagcggatcattgccgtggctgaccgggtcgatgaggacggtgccggcgttcgctcgtcggatctgaatcaggtaagccctgttggaatagcgaaaacccgacgcccgctcggtgtctaccgcaaacgggccgtacccttggtccaggcgttctgcggccgccgcgatctcgctcggggttacggataggttcggtatcccgccggccgggtagtgcagcggggtggggtcgggttcggtgccgcccggctgatcgtccgccggttcgcgcatatcaggagcgtgagcgcgagcccaggtcgataactccggccggcggcagtcctgcggcgtgttccagcacctcgcagaatgctttgacgtggacgccgacctcgggggtggttgccgtccacgaggcccgtagctctagctgatgggcgcgtggtggtccggagatgtcgccgtaacgtactgacgtggtggcggtgacggtgccgcccagcgcggtgacatgatctatgcgtgattccagtgcctcaatcagccagctccacgccacttcaggcagtagcgggtcaatggcttcacgcgagtccaggtcagactggatataggcgaccaaccggatggtgccgtcccaagcgtcggaaccgtcgggatcatataagagaatcagtcggccgaacgcgttgtcctcagattgctcggggacgatgtcgagttcgggatgcttgacctgagctcccagtgcgtagctgtatggcgcgagccgctgcggcggtcgaatgggaccgagttcaatttccggccgtacagtaaaagcgttcattgccgcgactgcctcgcggaagggagtcggttcggctgcggtcacgggcgccactcctcctcatcgcttagctccgcatcgtagccggcgcggatcacgaaggtcgacggtagccccatctgcccacacgccgtgacaggcgcgccgtgtcgtggtgttcgagctggtgtcagcctctccgggcactaccgaaatgcctccaggggtatttggtgttggcaacaaatagcgttaggagctttcgccggtgcaccacgagcccttcggcgacgttggagccgctgaacctgatgcgttctaggtcgagcaatgtttcgaaggccggatcgaatatgcggtaccagtaattcaggctgtatttggtccacgcggatcgtgttttgctcctccctgcgtacggttctcggcgagatggacgggtggtcgggagtatctcagttatcgtcgacgcaggttgagaccaggccgatacgttcggcttcctcctcgaagagtgactcactggtgagcaggtagtattgatattttaatctcagctatgccgaccagcagcggacagcaaattgcagcatggtcacgggccgccacccgagttcggtgtgcccatcgatgattttcgcggtttagtctgccacctgagatgttggcaagcagcgcaatcaccagacctgcacccacggctgggcctcgaatcggccgacaccaccggctggacgaagttggccagattgagcaccagatcacggtcttcgcgcaaaatgcgaacctggccttcgtagtcgtcgatggtttctgcggtcaggtctaagctactgcccgaagaaaacgctgtgccttcactgcggaccaggacgatgccgcacggcggggttgtgattgatcaccggccagatttcggtgaggtttcggtgcatttgcggtcccacagaattcagctcagacgcgttaagaatcaggttcaacacgctttcttggccaggattgtcgctgagtgtgcagcgaaggaatagaaaactcgtcgtaattgcctggtttcgacatttctgggcgctcctgcatggtcattgatgttacgcagcgacgtcggatatgcgagaccgatcgttaggggctcgaccggtcccgtggcagtattgagatcgatgagtacccgtcgcgagcttctcgaatcgccgtatctggccgcggtcagtggacgcaaaccctgccgggttccggtgtggtttatgcggcaagccggccgctcgttgcctgaataccgggcgctgcgcgagcgatacagcatgttggcggcgtgcttcgagcccgaagtggcctgtgaaatcactctgcagccgttacgtcgttacgacgttgatgccgcgatcttgttctcagacatcgtggtgccgctgtgcgcggcaggaatcgatctggatattgtgccagatgtcggtccagtgatcggggacccggtccggactgccaccgatatccacgctatgaaaccccttgaaccacaagcgattcagcctatttttcaggctatttcgttgctggtcgcagcactgggtgatgttccgctgatcggtttcgccggtgcgccgtttacgctggcgtcctacctggtcgaaggcggtcctagtcgtaatcatccccgcactaaggccatgatgctggccgaacctgcgagctggcatacgctgatggataagctgaccgatctgactcttggatttttgcttggtcaaatcgacgccggagttgatgccatccaggtattcgactcgtgggcgggaacgctgtccctgtccgattaccgccagtacgtgttgccacatagcgcccggatttttgccacggtggccgaacacggggtgccgatgacgcacttcggggttggcaccgccgacctgctgggtgcgatgtcagcggctgtgcggtcaggcgaaaagcctgggcaccaggccgtcgtcggcgtggattggcgaacctcgttgaccgatgctgctgcccgagtggaaccctgtaccgcgctgcagggcaacctcgacccggtggtgctgttagcgggctggccggctgtcgaacgtgtcgcacggactgtcgtcgacgacgggcgccgtgccgtcgtggccggcgcggctggccacgttttcaatctcggccatggagtgttgccggagaccgatcccggcgtgctgagcgaattagtatcgttcatccactcgctatgacatcccgctcgtattgtgttgtgggtggcggaatctcgggacttacggcggcatatcggttaagggtggctacgggtgacgatgttgctatcactttgttcgatcctggtgaccgactcggcggggtgttgcgcaccgagtgcgtaggcggacagccgatggacttgggcgccgaggcattcttgctgcgccgtcccgaggtgccggcgttgctggccgagttgggtttgtcagagcgccaacgcgccaccaccgatgcccgaccattgatctacagccagcaacggctgcattcgttgccaccggacaccgtcgccggcattccgtcctcggcgacgtcggtggccggcttggtcgacgacgccacagttgcgcgtatcggcgccgaagctgtccgtccgctgagctgggaacccggcagcgatcccgcgatggccgaattagtggccgaccggttcggcgagcaggccgtggcccggttggtggacccgctgttgggcggcgtctatgctggctcggcagcgacgatcgggctgcgcgcgggcgccccgagtgtggcggctgccctcgactgcggggccaccagtttgatggaggcggttcgacaggggttgccgccggtagcggccgggccggtttttggagcgctagacggcggctaccaggtgctgatcgacgagctcgtccgccgcagccgactgcagtgggtagctgccaccgtggtagggctcgatcgtgggacttgcggttggacgctagtggacgacaccggtgcttgctggtccgccgacggggttatcctggccgttcccgccccacggctcgtgcgcctgttgcagcagatcgccccccgaacagtcgccgccgcaagccggatcgtgagtgcctcgtcggcggtggtggcactgtcggtgccccgggacaccacattcccgcagaattccggtgtgttggtggctagcggcgagcggctgcgagctaaagcggtcacgttgtcctcacgaaagtgggggcttcaaggggacacacagttggtgcggctttcgttcgggaagtttggtgatcaggtggcctcgactgcctcggacgatgagctgctggcttgggcggtgtccgacctggccgcggtattcgatgtgaccgtcgaccccgtcgatgtatgcgtgcagcggtggatcgacgcaatgccgcagtatggccccggtcacgccgatctggtcgccgaggtgcgcgccggcttgccgccgacgctggtcgtggctggcagccatatggacggtattggtgtgcctgcgtgtatcagcgctgccgggcgcgcgatcgaggccctccaagcggaagtggcacgataagtttcatggccaaacttgactacaataccctgaactcgacgattcgttacctgatgttctcggtgttctcggtgcggcctggtgttctcggtgctcagcgcgacacagtgattcacgacgtccgcacctttttcaagcaccaggagaaacgcggtgtagtggtgcgcggcctctacgatatcgccggacttcgggcggatgccgatttcatgatctggacgcacgccgaacgtgtcgaggcgctgcaagcgacttatgccgatttccggcgcactaccaagctcgggcgggcttgttcgccggtatggagcagtgtggcactgcatcgaccggccgagttcaataagagccatatcccagcgtttctggccggtgaggagcccggcgcctatatttgcgtgtatccgtttgtacggtcctacgactggtacttactacccgaccaggaacgccggcatatgcttgctgagcacggtatggccgcttgtggctacaaagacgttcgcgctaacacggtgccggcgtttgcgctcggcgactacgaatggctcctggcttttgaggctcctggattggaccgcatcgtagacctgatgcgtgaattgcgtgctaccgaagcacggcggcatacgcgcgcagagacaccgttcttcaccgggccccgcgtaccggtcgaacaactcgtgaattcgcttccatgaagacccagttcgactcgagggacccacccgtttcggggagatgtagcgcgacgcccggttgttgcacggcctacccaccgccacgccgcgggatgtcggctgtccgcaactgctagtccagcagcgggtctcggtggggggcgatcaaaggtgaggtgctcgacccaagcactggcgcctatcgctatgtgatttactacgccgctaggggtactcaagtcaccggccgtcgaccggtcggcaagtgccatcgactgcgccctggacaaggcgcgcaaagccggagtgtcggtggatttccgggtggctgacgtgacgaagctggacggattggatgaccagtttgacactgtcgtcgactgagccttttaccacaccttcagcacagaggctgaattgcaaaagttctacgtacaagcgctacggcttggcaaccaagccgagcctaaccctgtaacaggctcgagtgcgagcacgcacgatgtcaacagctttgcatgccgtggtcgttgtccgaggatgatttccgccaggtgctttccgttaatggttgggagatcacttacctgggaacgatgatcggccaggttgacctcggtgtcgagaccttcgggatgatggccactcgaaacccggatatggccgagcgggtgcggttcgtactggaccggttccgagtcatggaaaccatggctgaccgtcggtaggttgcatgcgtcgttctgggaacgagaatgccaccggcgtgtactggaagccattagccattagagtttagcgtttgggtcgtgagatttaaaccgtagcggtgattactggcgtggtgggtgcaaccgtttaagtgtagcggcagctccgacgcatgaatgtgttgcgctacgtcctcgggcttaccctcaatgatcatacggatgatgatcacagccgagtttttcgagcttgcgccgctggtcctgatcgctgatgtactgaccggcgagttggtgcgatggtgatagccgtcatacttgacaaccaccttgtacttctacaagaccatgtcgacaacgacaatcagtcgccagtttggctgcacaggtatttgcgtggtgggaatgggcagataggcgtcgatcagcagtaagcgcagctacatctccttgggcgacgcggcgcccggatcggtcagtggcaccgtcgcgtgtaacctacgcaggcgctcgcgcacccgggtatcgcttggctagcagcacgtcctagctcgaatacggcgttgcctgcatcagtgtgtcgagccgcgtaaccgccttgccggtgggcaattgtacggctaagtcaaacgccgtttttgcgcaagtggtcaccagcagaccgacgatacgggtaatctcgtccgacttgactcgctgattacgggtgatcacgccgatcgggggatgtggttacgccagatcaattcgatggactcatcgtcgtcattacaatccgaaccgtgcagcgccgccgcggcaagaccggccaggacgtcgcgtcgaccagaaccacaaccacgccccaaccgaacacgttcgcagcgatgacgaggtgcaatcctgcagataaatatcggggtagatcgcacgtaacccggttacataactgatacgtgcctagtctacccggccacacggcctaacggcccacaaaacgttgtccacaaaggaaatgaagtcacgacggatctgcaagattgttgaattgtactttgtgtgcatgttctgttgtgggggtggagtaaagggtggcggtgtgttgcagtgttgtgagttgatgtgatcgatcgttaaccgttcgtttgggttgggtgggggtggggatcgtgcgtgagatcaccagcaagggtggggcccgcgtgtttgcgggttgctttgggggttgcactgattcgacaccaactatgctggctaagacgctcaatcgggttactgagcttgtattgcttagctatgcagtgagcagtgggcccagtggctttaaaggccggcaaggtgagcgttgtgggcagctgcgtacggagatagacatgtgtgctggccaagaagtacagtcccgaacaaattgtgggggtgttggcccaaaacctatcccgaccggcccgaaagatgcaggtgtcctataaaacacttcaacatcgagtccaagctcaaccaacatgtgcgcactgggtggatgttccgcacgctgagggcacagcacgctaaaaccgggcaccaccattattctctaggtatggccaccaccagtgcacgtcccgcgaaaactacacgaccgtgtggtgctctaacctcatagcattgggcggatgatgtaatcatcggcaaaaattagacccccaaatcggcgccctggccgaacacaagtagcggattcgtgcagctgctacacctatccaaggaccacagcactgatgtgatcactgcggccatgatcaaccacaagacaacgccctaccacagaatcgctgtacaaccccagcgtgagaccaagacctcgaaacgactctcatacccgcatcaccacggcatcgataccgacctttgcgacctgacgcaccgacccgccaatacactgacccaccaccctttactccacccccacaacgagtccgcgctaacattaacctcaacacaaccgccagtagtcaccacccagcgagcccggtaatcgagcaagtagccgacaccgatgcggccaaggtgtgcgtgcggctgcccgataatcggacgcctggacgttgcagtgcagtagctagcaggggcgctattggtgtcgatgttatgtgcgggtggtgggcacaacgaggagttcgagcccgttgcaagtgagtgatttttagtgctaaagctacttgcactccgtctcggggttgttcggcagccttgccggctgcgtctcttccgtgctgcttggccactcacagcatcaggcccggtcttaccggtcggctccacgcttgactacggtccaaactgagcggacagagctagctgtttcctcgtagcgtgcgatgttcacgggggtgttgttatcgcgttggtgcgtgacttaaccgccgtcgcattgccatttttcgttccagttgatgtcctgcacatgcccgcagccatggcaggttttcgacgacgggaaccttcggtcggtgattatcagtgctgacctgtaaccagcacgtcttatagacgagaggccgtagcggtgtgcctaaggctgcttccgataggcctcgtctacgtgcgcgggcgtcctggcaatcccttctaccgtggcattcttgccgcatctaggctttcgacaacgaatccggacgcgactgggggaccgcagctcattgagtggcggtgaattcggcacttgctcgagtattgtgccgtcctagttggttaccgtggctaggtgccgtcccgatatcatatcaatgtcaacccgttaacctgagtgcgccatcttcagttgctgcaggcgctgcgcgaggacctgcacactcgcgtccaccctgatgccattacggcgcaccgtgatcgccagcacctgagcccggtctttcgtagtgaaccgtttaactcggtgcgtgttctagtgcgtacggacggttctgatgactggaagtgcgaggtggcggtgcccaggtttgacgcgcatcgcttaagtcgtgactgatacgcggtcatggttacgtccctgtcttcttgaaccgggggaagcccgatcattttgctgtcacgtttgccggatcggaagttttgccagtttcagtacgcgtcgaccgtgccgtcgatgctgtccggtgtagatctcttcggaacactcgctccaccatgccgtgccggtatcgatgttgacgtgcacctcgttcttgaaggtgttgcaacgcttccgcagtatccgaagtgtcgatgtcgcggtctctaccgtggtggcgccacgcctcgatgtcgacttttagggccgtgacggtccaggtgtatgccttacaccggtcaccgaaatgtcttgccagcataagcgattgatcgtcggtcgggtccagggtgaatcgccaagcttgcagcaccgtccagtcctcaggaatctcgaactctgccatcatgttaccttgcgttctccggcgtcagccgccgcagcgatggcccgcttagcgtggttctggacagttcgattgtcatacaaccgaacacacatactggttcagtatctcggtcatgtcctgcgcccgatcgtcgtcaacttcggactaatccaccacaacaagactagtggtcctgcgttgccagcgctgcttggacgtagtccgatctgaaccggcagaaccggtcccgatgctccacacgatccagcccaccgtcggatcatgcagcagcgcaagaaacttgcgccggtgactgttcagcgtggatcagaactcggtaacgaccttatcgaccgggctctgccggaccgtggtctacgcggtcacctgggcgacctgccgacccagatcagctttatgatccgctgaagacacccgcgcatacacccagcgaccacacacgccacctttgccagtcggctcatcgacaagaattagcaggcccactcgctgcgctggtaccggcaacagcctggctcgaagccaacaatacgcagttccgcgcaacaccgctgtgcatcaagcccgcgctgcgagattcatacccctgttcctacaacacaccactgacaactaacggctactcagaccgcaacagctgacaactccgtggtctcggttggccgttgtggattgggtcccttaccgggcctgacagcaccgcacaggccgcgtcgacacgggttagcataaaagttaaagccgtgtgtcactaaactggtcatcaatgagcctgtgcaacatgccgcacgggccatgcagtcccacacactccacagtatcattttagtacagtagtctgtcacatgcaaagctttcggcatggtccttgctacagttcgcctcatacttgagggaaacatcgccgtcggcgactatcgccaggtaggctttgccgagttcggtgttccacaggggcgtggtcttctagttgcacgacattccggatgcttgtcggcagatttccagccgaggcacggggtttacgcggaaggtcacaatatccgtctgatcgatgttaaccggcttgggattggcgcgtcgacacgcgtatcaatacccagccagcgatagttgcgttcgtcgacgaccggcccaaacgggatcagtgccgatgtggtttgcttgtcgcgccgctgctgaaaatggaaggtagttcgctgcgggtgtgcgctagtttgctggtccgggcggctcggtcggtaactttcccacgctcgactcgtatgttctgctctagctgcaagcagattggcatatgctggctcgtcctgagttcaaggtgatgtttctctacaatttgctgaccgggagctacaagcggttagtcatgtcgttcgtttacgtcatcgcgtttgcccgccattgagattcgggttgaattaggtgaaagttctgttccgctggtggaacggtgaccacgaccacgtcattccgttttcccatggggagcacgtcgtttctcggttgtccgatgccaagcaagtttcacttgccgggagaaagtcagcttgcttggcttggccgaggcgaggaaattctgtgcaccttgatggcgatttaggaccgctattagcgagcgtgactcggtcttgcaactaccccgggtaaccttgctcacgtgttgttggcatcactgaatccgtccgtcgttaccgccaccgatatcgctgacgcggtatgtgttgacggcgtcgtgctgagccgcagcggcttggttggtgccgcaacgtcggtggctgagcgtgtcggaggtgcacgcctggtagcggtgctggccacgccgacggcatcgactgtgctagcgattactggttgcctgattgccggtgtgccggtggtcccggtgcccgcggatatcggtgtggtcgaacgccggcatatgctcaccgattctggggcgcaggcctggctgggtccggggcccagtgcggactcggcgccggacgggttgccgcatatcccggttcaactagatgctcgctcctggaaccgctatcctgagccgtcacctgatgccaccgcgatggtgatctacacctcgggtactactgggccccctaagggggtactgttgagccggcgagcgatcgccgttgatttggacgcgcttgcccaggcctggcagtggacggccgatgacgttttggtacatggattgccgctgtttcacgtgcacggccttgtactcggtttgcttggatcgcttcggattggaaatcgctttgtacacaccggaaaacccactccgaccgcctatgctcaggcttgctctgaagccgggggatctctgtatttcggcgttcccacggtatggtcgcggctggtggcagacgaggcagttgcccgggcgttaagacccgcgcggctactagtgtctgggagtgcctcattgccggttccggtatttgatcggctagcgcacctcacaggtcatcggcccatcgaacggtatggcagcacggaatcactgatcaccctgtcgacgttggcggacggtgagcgccgtgcgggctgggtgggattgccgctggcgggcgtgcagaccaggctggtcgatgagtccggaggtccagtgccctacgacggggaaaccgttgggaggcttcaggttcgtagtccgacgatgttcggcggctatctaaatcgaccggaagcgacagccgaggcgttcgacgaggacggttggtaccgtacaggtgatgttgcggtcgtggacagtggcgggatgcatcgcatcgtgggtcgcgagtcggttgacctaatcaaattgggcggataccggatcggcgcaggagaaatcgagatggcgctgctaggacatccggatgtgcgggaggtggcagttgtcgggctgcctgacgaggatttgggtcaacggatcgttgcattcgtcgtaggcgcagaggcattagatgccgatgagttgattaactatgttgcccaacagctttcgatacataagcggccgcgtgaagtccgcttcgtggacgcgctgccggcaacgcgatgggaaaggtcctcaaaaagcagttgctcttcgagggctgactggcgctacgacgagtagtgattatgcgggcacgccatcgttgcgaccggcacgggggccggatgtgttggtttggtcgccgcgccactgtagagcttcaagagccacggcaatgtggacgctagtgtggtcgaggggtcgcggtaggagtttttcagcggactcaatcctgcgtagcaaggtgttgcggtgagtaaacaaacgtttcgccgcacgggaggcgttgcactgttcattgatgaatgtcaataacgtttgctgcaatgccggactggctgattcgaaatctccgagcgtactggtgataaattcttttgcatcttctggattttgggtgatcaacgagaccagttgcacatcagcaaagaacgcgacctgttggtgagatttcagccgggctaaggtgcgttgtgcggtgagagcttccaagtggctgcgccggaaaccttcgattccagctgagctagtcccgatggcaacacgcgccttagataggttgagcagcgccttttgtacctcagggacatctagggcgagtgcgtcggccaaccatacccagcgggtggcggcgcttgctaccacgatcaattgctgggttgactcgacgacgtggctaaatgcttcagcggcctggtcgaggtagccatggtcgccatcaaggtcgtcgctccagatcacggcggcggtatgtgttaggccgagacgatagcccaagcgcgcttcggcacgctcctgggtgactggtgcgccctcgagaatcagatcgacaacttccagtcgttcggcgtgtgtgctgcgggtcagttcgtcgcgttccagttgcatgtgcgtggcgatggcctctagcgtggccgctacgtactcgttgatcgattgcgcggatacgttaagtatttcgcgcagttcttgggggtcggaggtgagtgtgaacgcgatctccatccaccgtcgccaggctgtgtactgcccgactctataaatgtcgagcgcaagaacgtcacgcccgcgccgcaccagatcccgcgccatggttaggggctcagggccgagatgagccggtaccggggcgccagggtcacgtaaattggcggtagcccagtgcaccagatgggcacggctggcgcgccgaacgaccttggccaggaccgggtcattggcgatggcggggttggctgcgaaggtagcgcgatcaagttggtcgatccactcctgggtagggttgagcgcaatccgtgccccttcacggatcagttcacgcactcgtggcgacgggtgttgcctagccatgggctcactgtagggccgatgtatgcagattgacaccttgggtcgagccaaatgggaacatttcacccctgagccgtcgcagcgtaactgtcgtgtccggcgtaaattctttgtgccatcaatggcgtcgatgtcgacggtggatagcgggagcaagtggtccggaacaccagcaattgtgttgagtttaagccaagtaccactaggtgaacacgggctagacggatggctaattctgggttctgtctgcggagtgtgagtccgactgattgccggtctagtgtgcattctgcaccttcgtatgggcaaaattgggaagattgtaccaccgtccgggtcgatggggtgcactttgcaccttaaactgcggcaactcgggtggttttaacctgttataaactcttaacctgttgtaaacgttgcataacggagatcattaaggccagttcgtaccaccaagcagtcggaagggaggcgcaggtgagcaggtcgcttgagctttccccgtgcagtagtcggattgtttgagtttcgaggaggaaccgcatgccccttttcttgaatgcagagccacaggccctgaccgcggcagctaacaccttggagggcctcagtgctgccacagtggcaagcaacgccgcggcggcccagctgaccactgaaattgctcccccagctgccgatgatgtgtcaatcttgctagcacattttttcagtggccatgggagacagtaccaggcgcacgcctctcagggcgcgaccaatcatcaggatctaatccagagcttgttgacgagctcgtcagcatatgcgggtaccgagactgccaatcacgatagtttatagcggacgtcgctagctgcacacgagtggctaccaatgagtaataagggagcgacgagatgttcgatttcgcagcgctgtcgcccgagaccaactccacccggatgtatctcggcccgggctccagcccgatattgaccgctgccgcagcatgggttgttctggctaaggagctgactgctgcagcgcaggggttgcagtcagcggtcgaagcattactaacaacatttgaaggtgagtcagcagcggcgctggcagagcgggtcacgccgtatgagaagtggcttacccagaacgccgcaagcgccgagctgaccgcaacccagctcacggtagcagcgaacgcctacgaaacagcttttacaatgacggtgccgcccctgatggtgttcgtgaaccgcgcgcaagcatgcctgctgattatgagcaacattttcgggcaaaactccaccgcgatcgcggagaaggaggccgaatacaccgagatgtggatccaagacgcggcagcaatgaccagctatcaagctagtgtgctggaggcagtgggggcgacgaaagcgaatcggcgccgctgctggggggcgggctaccgatggcacctatggtccctggcggaggcagcggtactggcggcgtcaacactgcactacgcctgcaaccaagagctttcgtgatgccccgcaaccccgcagcgggataaaagctgcgaggttgacgtttcatccacaacgcaacgaaatcaatggaaggaaattataaaggatgacagctgcacattttatgaccgacccacaggcgatgcgggacatggcgcgcaaatttgacatgcacgcccagaacgtgcgagacgagtcccacaagatgttcatgtcctcgatggacatcgctggtgcgggctggagtgggaccgcccagttgacctcccacgacaccatggggcagataaatcaggcgtttcgccacatagtgaccctgctgcaggacgtgcgtgaccagctgggtaccgccgccgatcgctacgagcaccaagaagagaactcgaggaaaatcctttctggcagctagttgcgaaaatcgctgctaatcaatactttcagtgcaggaggagacaaagtaatgggaaacattaactaccagtttggggagatcgacgcacatggagcggctatccgcgctcaagcggctgcgttggagaccacccaccaggccattctagccactgtgcgggacgccgctgagttttggggcggacaaggttcgactgcccatgaaatgttcatagccgacctgggtcgtaacttccagatgatttacgagcaggccaactctcacggccaaaaggtgcaacgcgccagctcctccatggctgacactgaccgctctgtcagttccgcttggtcctaacgtaaaactacctaagagccgctcgctgtcaatgtcgacaccgggcggcttttccggcagtactgaagatcaggacttctcagctgcgagagcgctacctggcctgtagtccgatcaagttgtacttagggggatttgtgcggtaatgcctgtcggcttgtccggtaggaacaagtgcagaggagaacgagatggatttcggggcgttactacgcagagattaattcggcgaaaatgtatttcggcttgggttcgggctcgatgttggtggatgtctttcccgcggctgaggaggttgtcgaagatacggtgctggtactagtcggtgacgaggccgcagcgttggagcagttactgggccagacggctgatgtggccggcgcggccaaaagcgggcctgtccagccgatgggggatcgagggtctgtcagtccggtcggacagatggtccgcagtgcgctgcggactccgacgcgcgctttcgcgatgcccagttccccagccgccggatcgctccacttaggctaaattcatccccgacggttggccactcgctaccgttacttcggataagtgctggctgtgcatctcgtcggtgtcagcggtggggtccggcggttagttagtgtgcaaggcttcgttgagcgtgctccccctaccgtcgcgggctaccacctcgaccgcccctgttaccgaattgcgtcggaacaacaggttgctaccgccggagagcgcacgagccttaaccgatttgccttctggcgtattgaccttggtgccggtagtgacatataagccggcctcaacgatgcagtcgtcgcccaatgagatacccagacctgagttggctccgagcagacaccgcttgcctatggaaatgacctgtgtgccaccgccggacagggtacccatgatcgacgctccacccccgacgtgagagccttcgcccaccaccacccccgctgagatgcggccctccaccatcgatgcgcccagggtaccggcattgtagttgacaaagccctcgtgcatcacggtggtgccaggcgctaagtgggcgcctagccgcactcggtcggcgttggcgatgcgcactccggtggggacgacatagtcgaccatcctggggaatttgtcgacgccatagatggtgaccggtccgtggcgacgcagctgtgcccggacggtgtcgaaaccgtcgattgcgcagggtcccctactagtccaaaccacattggtcaatactccgaacaagccgtcggcgttcagcccgtgcggtgccaccagccggtgtgacagcatatgtaaccgtaggtaggcgtcgtaagcgtcggcggcgacttcgtccaatgagccgatgaccgtgcggaccgcgatggtctcagtgccacggtcgtcatcgcggccggtaagtacggccagctcgtagggaacgtcggacatcgccagttgcgaggtgacgctggtgcccgattcggtcagtttcggtgcgggaaaccaggtgtcgaggatcgatccgtcggcggccagcgtcgccagcccgatgccaaccccacctgcagttcctgtcacggcggtcaggttacttgctcggcctggaagacgtcatcagtaccctggtctgcgtgctggatttgcgcggggacccgattgagctgaccgcggcgctcgtcgacatccccagcgagtcacgggctgaagcacgcatcgctgatgcggtggagactgcgctgcgggcccagaccgccggcttcgagattgttcgtaacggcaacgctgtgttggcgcgcacctcgttgcaccggccggcgcgggtgctgctagccgggcacctagacaccgttccggtggccggaaacctgcctagccgctgcgagaaggacgtgctacacggctgcggcaccgtggatatgaaatccggtgatgcggttttcctacacttggcggccaccgtgaccgagccggtgcatgacttgacgttgatgttctacgactgtgaagaaatcgattctgcagcaaatggtttggttcgcatcgagcgggagctgccggagtggctcgccgctgacgtggccatcctgggtgagcccaccggcggctatatcgaggccggctgccaggggacgctgcgcgttgtgattaatgcggctggatcccgtgcgcattctgcacgttcctggttgggcgacaacgcaatccataaactgggtgctgtgctggaccggttggctgcatatcgggcgcgtaccgtcgacatcgatggatgtgtctaccgcgagggtctatctgctgtgcgcgtcgacggcggtgtggccggaaatgtgattcccgatgcggcctcagtgacagtcaattaccgctttgctcctgaccgttcggtggccgcggcgttgcgccatgtgcacgacgtgttcgatgggctcgacgtacagatcgagcagaccgacgcggcggtgggtgcgctgcctggcctgtcgcagccggccgccaaggccttggtcgaggccgctgacgggcaggtccgtgcgaaatacggttggacggatgtgtcacgattcgccgcgctgggtgtcccggcggttaactacggccctggtgaccccaacctggcgcaccggcacgacgaacgcgtgccggtcgtccagatcaccgctgctgtggatatgttgcgtcgatacctcggcggctgatctttggccgtccgtgatcggcatctggtagccgttcggctactgcgacagcagccactgagattatcccgatagctgccagcttcgcagacacagccgtcagggcagcaggatcacgtgtggccaatgcgcgttgtgccattggctcgacattgtagaaacggccttgccgctccgcgcacagtgtggccgcgctggcctcctaggccacccgccagatcacattggtcgacggtaagttttcagccacattgccggtgatttcggcggcttttcgacattgcccgcgttcatggcataagatagcgttaggcgcgtaggcctgcatccttgacctgattgcggatggttggcagaaatgcggtagtctatcccggctcccctagcatagggaattgtactggtgtcctacagcagtgttcaggccatcagatccggtggcgacagtgttgcggggtcggtgttgtttggcaacgcaccggcgttccggcctcggacttgccagggcgttggttagcgacagttgtgcatccaggcttgggggtctgggaagcgttgcagcgtcgagcgggttagtcgttagcccagtgtgaaggtcgctgagtcgcagcgtttgcttcgcggcggcgacttcatctaactgcttcggggcatcgctgtccaacaccagggacgccagccgcggctggtcactaagattgtccgacgaatgccgcaaatgcagcacgaccagatcggtgcggcgccatcgcgcaccgtcggcgtcaagcgcggcacgctcccgctcaccgaacagcggatgcgctgtgtaaatcatcgggttgtccgcgggttagttgcgtattcgggtttctgttgcgcctcattcttcggtctgccttactgtgccgtcgccggcgagggtggtgaggtcggcgagcgtcagcggctcctcgacggcgaggtaatccagtatcgtccgcctcggcataggtaacttggcgattaattcgtcgacctccgctggctcgggaggactttagtcacgtcgctgagtgcgtcccgcttcagcagaccttcggtccacagcgctgcactggtcctaggggcggcgtcagcgcgggtagtcacaatcatccggggccgtgacggtcagcgctaactgttacaccagtgtggtcgataggacgtctaggtcgtgggcatcgtcgatgacaagcagcagatcgcgcgccgtcgattcgtttttcgcctcaacgatgctcgggctgctcaccataacgcagctggtttcccgatatgggtgatgtcagccgggtggttgaaggcgccgaacgggaccgcactcggttggggtgccgataacctagcggatgacggtgctcgggtggcgaccgatgaattgttcagcggccaagcgggccaagatgggcttgccgacgccatcggctccaagtacaacggcacccacccggagacgatgtcgggtgggtgccagcttgacatggcggagcggggcgatttgatcccagactacgacaacctcacagaggggaaacatacagctgccccaaggcggccgcttgttgagggatgttccatcgaatcggtactgccggattttagttgtgtgcgggccggctggttgtgtggctggtgtaatggtcccaatggcgtcgggtctacctttgaacgactatgcgttcggatcgcggtaaacccaatgcgtgggcgatttgtgtcttttgcgcggctggaccgatgcacccggagctgctcgaactggccgccgaacttggtgaggcgattgctgagcgcggctggaccctggtctggggcggtggccgcgtttcagcgatgggtgcggtggcgtccgcggcgtggacacgcggcggtcggatagtcggcgtgatcccggaaatgttgcaacgccgcgagattgccgacacctatgtcggtgagctgatcgtcaccgaaacgatggccgaacgtaaacaggtcttggacgatcacgctgatgcgttcatcgtgttgccgggtggtctggggaccctcgatgagctattcgaagcatggaccgcgggctatttgggtatgcaccgtaaacccatcgtaatgctggacccctgggggcactacgaaggcctttgggcttggctgcacggattgatcgatagtggctatgtttcgccggtagcgatggagcggctggtggtggttgaccaggtggatgccgcgcttgaggcttgtatgtccgtctgagtttgcttgacaacggaaatttggagtgtaggtctgacccacggtgctgcgcgcacaattgagtcaacctgatcgatatcgtatctggggtcgctggcattttggccgatatgctgttgatcatatgaggagtgctgaccgggctttcggcttggccgagctcgaagaagtcgatcggcatcgtctatccagcagcgggcagctcgctccggtgactggattttcttcagattcgccgatcagctagtgagctaccgcgacggcaacgttaccgccaaccagtacgcagtagtggctggttgcatgcggtgtcggccctcacgacgtcgttgcgatgatgctgcgcaactcgtctaatacggtgctggctgtggttacgtgtgggtaccatgcggcgggcaatgcgcaactataaccagttgtgacgaggtattggcgcccagcctgggcttgctcgacgccaaggtgttgatcgcggagaccggtttggtcagcgctgtcgccgaatgcagtggctcgagtggcagcgagccgctgaccatctaggatccagagcgattcgtcgcgacagctcctgccacggcttctgcagtgttggcgaaagacatcgccttcgtacattttcccctgagggatcatcgaattacccaaactgagtgtgatgacttactactggcggctacgtgggctggtggcattcgacaagctgggcttatgcttgaagaactttaacacatggtacatccttttgcaaccataccacaaataacgctctgacggttacggcggcttccgtggtcgattcgaccttgacgttggccctggttgagctgtttttggcgttgcggttctaggaatagacgattgccagccggaccacggcgttcaatcgacatccagccggccaagctgaccgactggccagcaccgggtgcgcttgatcgccagcaaggggctactaccggagatttggaacgagttcaccacacgtttcggcattgcgcgggtgtgtgtgttgagtatcgttgcctctagcgaaggcaataccgcttcaatatcaatatcttcaatgtgtacggaactaccgggttctcgccggagccgctggctggtgtggagtatactattgacactggtgctccgctgcgcgacgctctccgggttggtcactgctcgttcaattcaggcgacgtgatgaggccgcacggtatgtgacatggctgcgtttgtcgaccggcttggtgacgcgttccgctggaagggtaataaagtcgccaccacacaggtcgaagtggtgctgacgtccgacaagtccgtcgaggagtgcatgatttttggtattgaggtttcatgcaccgccggctgcgccgggatggctgcgatcaagcggggcgaaggcgccgaattcgacggccgatttctggcccgcgcggtgtacggccagttgtatgcctactagctgccgctgttcgtgcggggtggtcgagtcgattatgcacaccaccacgtgcaagagttgcaaggtggagatgcgtaagcaagcttatgaccctaaatgtagcgggcccgctgaacgtgttggtctgccgtgccgacggctattttccctacacatactacgataggctaaccagccgaagtgtcgtctgtcaggtaagcgactgcaaggctgacgtccccgctcacgcgagtgtgcgactggtcgcacactcggcgtgaaggatggtcccgcaacaatgcggctggtcgtcaccaggcaatattgactggtgcagtcaatgctgtgcggccggccggtcgcagcggatcgccaactgatcatggcgatcgtcaaccgtaccccggattcgttctatgaccggggcgcgaccttcagtgacgaggctgctcgtgctgcagcgcaccgggccgttgcggagggcgccgatgtcatcgatgtcggcggcgttaaagcagggcctggtcagggcgttgacgtagacaccgagatcgcccggttggttccgttcatcgaatggctacgcagcgcctatacagacctgctgatcagcgtagacacctggcgagcagaggtagcaagactggcttgcactgcgggcgcagacctgatcaacgacagctggggtggagccgacccggccatgcatgaggtcgccgctgagcttggcgcgggcctggtgtgttcgcacaccggtggcgcgctgccccgcacgcgtccctttcgggtgagttacggtacgacgacccgcggtgtggtggacgatgtgattcgccaggtcactgcagctgccgagcgcgcggtcgcggccggggtaacccgcgattcggtgttggtcgacccgacccacgatttcggcaagaacactttccacgggctgctgctgttgcgtcatgtagacgaacttgttaagaccgggtggcccgtgctcatgtcgttgagcaataaggacttcgtcggggagactctgggcgtgggtttgacggaacggctagagggtacgttggcggccactgcgttggcgcggcagctggcgtccgcatgtttcgggtgcacgaggtcgtagcgaccaggcgggttctggagatggtggcttcgatccaggggacgcgtcccccaacgcgcacggtgaggggactcgcatgacggcatcggagttgatcgccagcgcgctagcggcccggtccggagatgcgtggctcgcggatcgcagctggagccgtccagcctggacgatcgacgaattggtggcagccaaggccgggcgggcaatctcggtggtgctaccggctctcaatgaggaacaaaccatcgaatcggtgatcgacagcatctcaccgctggtctccgatcgtgcggggctggtcgacgaactgatcgttctggactctggttcaacggacgagactgagatccgggccatcgctgccggcgcccgagtggtcagttgtgaacaggctatgcctgaggtcccaacccggcccggcaaaggtgaggcattgtggcgctcgcttgctgtgaccagcggcgacatcgtggtgttcgtcgattctgacctgatcaatccgcatcctatgtttgtgccgtggctggtcggtccgctgctcaccggcgacggcattcacctggtcaaaggtttttaccggcggccactaaacagcaacgatgcgggcggcagtgctcgtgccaccggtggcggccgggtcaccgagttggtggcccggccgttgttggcgtcgttgcggccgcagttgggatacgtgctgcagcccctgagcggcgagtacgcagctacccgcgaattgctgacagcgttgccctttgcaccgggctatggcgtggagatcggcctgctggtggacacctttgatcgactgggtcttgacgcgatcgcgcaggtaaacctgggcgttcgagcgcaccgtaaccggccgctggctgagttgggtgccatgagccgtcaggtgattgcgactttgctgtcgcgttgcggtattctcgactctggggttgggctgacccaattcttcgtcgacgagtccgacggtgacgggtacatccggcatacttggtcggtgtcgctggccgatcggccaggctgagcaggttgcggccgcgttaaggcaatatcgttcctgtggcgttggttttgttgtacctggtggtgttggtcctcgtcgcgatcgtactgtttggcgcagccagcctacttttcggtcgcggtgagcggctgccgcctttgcctcgcgggacgacggcgacggtgttgcctgcgcatggagtcaccggcgctgatgtcgacgctgtcaagttcacccaggtgttgcgcgggtacaagcccagtgaggtggattgggtgctggaccggctcggccgcgagctcgaggcgttacgtggtcagctcgcggctatcgccgacgccgaagcagatgccgatgtctcgaatgttcccagcggggacgacggccaggatgtgacgtgagcgacgatgggctggttcgctgtggctgggcggacgttcgatccgggctccactggcagctgtatcgcaactatcacgaccaagagtggggcagcccagtacgatgcggagtggccttgttcgagcggatgagcctggaggcctttcagagtggtctgtcgtggctgctcattctgcgcaaacgggaaaatttccggcgcgccttctccgggttcgatatcgaagaggtagcccgttatacccatgccgatgtgcaacggttgttgttcgatgacggaattgtgcgcaaccgcgtcaagatcgaggcgacaatcgccaacgcgcgtgcggccgctgagctggggtctgcagcagacttgtctgagttgctgtggtcattcgccccacagccgcggtccaggcccgctgacggatccgaaatcccttcgaccagtgcggaagcgaaggcgatggcgcgtgaattgaaacggcgcgggttccgcttcgtcgggcctactacggcctatgcacttatgcaggctacggggatggttgacgatcacatctgtacttgctgggtgcctccaacacggtgaccccaactttccgaacgggccaccgacgaggccttgttgtggggggcacacccagccgcgcagcagcgatggagcgagccgggcaactaggcacagcatcctggttaagcccgagaaccgggtctttgtgcattcaccgacctgaatagggaagaatagaggggtgatttggcagttcaatgttgggtattactgtaaatcccccgagggggcatgctcggcgccgaatgggtccgcgagggcgggccagctcgagtttggagggagcacacgatggcggcgatgaagcctcggaccggagacggtcctctggaagcgacgaaggaggggcgaggtatcgtgatgcgcgtaccattagagggtggcggacgactcgttgtcgagttgacaccggacgaagccgccgctctgagtgacgaacttaagggcgtcaccagctaaaccggccgtctggcaggtagttttggttgtgcacaactttccggtagatgtctagcgtttgttcggcgacgtgggcccaggagagttccttgatgcagcgccggggtccggcgtgaccattagccttcggcttttcctgggttggcgaccaaatcattgactgccgtggccaacctgccctggtaaccagtcgggtcgtcggggttgtaatgcaccagtgatccggtgatcccgtcggcgattacttcaggtacaccgccaacgtcgggggccactactgctgtagcgcacgccattgcctccaggttcacgattcctaacggctcgtgcaccgaaggacacacgaagactgttgctgtcgaaagtatttcgcgcatcttcccgatgggaagcatttctcggatgcaaaatacctcggtgcgattgcgggttagttaggagacggcggtccgcactttattgtttaactccagggtatcgggagtgccggcgtacagcaccagctatacgtccgggctaaaccggtgcgcggctgtcgccagatgagcgacaccctttctgtcgggtgatccatccgtcccacgaacgccacagtgggccagcttgagtctataccgagctcggacagtaccggacccgggtcggatgctatacatcgcgttccagatgacgtgcaccagtctcggatccagcgtgggatagatccgcagcataccggagctaaccgcgatgatcgcatgagcacccagcaccgcggtgtgctcgacccacgtcgacacccggtagccgctgttggattgttcggctttccctgggcgcagcggctcaagtgagtgtgcggtcagcgcatgggggatgtcgtagagcaacgcggcaagatgcccagccagaccggtgtaacaggtatattaatacacgatggtggccgctgacgcggtactggccgtcatcagatccgacgacaaggtaggtagacagtgccgcgttggcatcgtggaaccggcggtcaggctgatggtcctgggtgccggtgcgaggtgcgtccatgcaatgcgcatcgaccgcgcatagttggcgcagttgtgcgaccagttcggtgacgtgtacccccggtcccaccgtaggactctggcgggtactcccgagtcatcatggccacccgcataccggctcaccgtaatgcggtgactccgaatttgcgagtggtgcgtaagtcgagcccggggagaacctgaacagtgcgtcgaaccgagccaaataccttgacggacaggcacgtcaggacggcgccgtcgagggatgcccccctggcagcggtgggcagcggccgataggtttggagccatgagggaagtgccacaagtgctgggcattgttttggccggtggtgagggcaaacggttatatccgctgaccgcagaccgggccaaacccgctgttcccttcgggggcgcctatcggttggttgatttcgtactttctaatctagtcaacgcccgttacctgaggatttgtgttctcacacaatacaagtcgcattccctagaccgccacatttcgcagaattggcgattgtcgggccttgccggtgagtacattaccccggtgccagcacagcagcggttcggcccacactggtacactggctcggcggacgcgatctatcaatcactcaacctcatttatgacgaagaccctgactatctagtggttttcggagctgaccacgtgtaccggatggaccccgagcagatgctccggttccacatcggcagcggggccggtgccacggtggctggcattcgcgttccgcgcagcgacgctacagcgtttggttgcattgacgctgacgactccggccgtattcgccgtttcactgagaagccgctcaaaccgcccgggacaccggacgatcccgataagacgtttgtttcgatgggcaactacatcttcaccaccaaggtgctcgtcgacgcgattcgcgctgacgccgatgacgatcactcgtatcacgacatgggcggcgacatccttccgcggctggtggacggcgggatggccgcggtgtatgacttttcccaaaacgaagtgcctggcgctaccgactgggaccgcgcttattggcgcgacgttggtacgctggacgctttttatgacgcccacatggatctggtgtcgttgcgtccggtgtttaatctttacaacaagcgttggccgattcgtggcgaatcggaaaatctggcgccggcgaagtttgtcaacggtggttccgttcaggaatcggtggtgggtgcagggagtatcatttcggcggcttcggtacgtaattcggtgctgtcgtcgaatgtcgtggtcgacaacggcgcgatcgtggagggcagtgtcatcatgccgggtgctcgggttggccgcggcgcagtgatacgccacgcgatcttggataagaacgtcgtcgtcgggcctggcgagatggttggcgtggatcccgagagagatcgggaacactttgcgattagtgctggcggagtagtcgtggtcggcaagggtgtgtggatttagctcggtgctagctaggccagttgttgagctgtgtcgacatgtttgtcgaagcctatcgacacttgggtaagctatgatcgtggttggtaattttacgcagagcaattacgtgcctgcgtcgcgaggccgtcggtcgtcgcagctctccggcgacgaccgagaacaggcaatcctggccgttgctgaacggctcctggcggagcggccactgggtgacttttccgtcgatgaactagccaaaggcgccggaatctcgcgcccaaccttttatttctacttcccgtcaaagaacgcggtgttgttgtcgctgcttgatgatctgaatatgaagtcacgctcggcggttgaagcactcgctgaacagctgcccgcggaccccgccgcggtctggcggtccgcaatcacggcgttcttcgaggtgtgcgggactcaccgagcggtggctgttgctggtgccgcggccaaagccactagccctgaggtacgccggctgtggtccacagtcatgcagcagtggatcgactacaacacagctgcgattcaggctgagcgcaagtgcggcgtagcccccgacaccattcccgccgaggatctggctgtggcgctgcaattaatgaccgaacgcgtgatggccgcgacattctccgacgaaaagccgttgatccccgataagaaagttatcgacacgctcgtgcatatctggttggccagcatttacggcagttgaccgcgcaccatacgtaaggcgccagccgatagcgcacctgctgtgtgtattggcggtatccgctcaattcttgggtaaagctaccttctcctcgtcgcggatgcggaagacgggcaccgccacaccggggatgaccagcagccccagtaggacccgagcgccagcggtacgcccccttgccatgaatcacgttgccgacatacatcgggtgccggatgaacttgtatataccgccaacgctcatcgtctggccagcttccacggtgacggtggttgccgcatagccgttctggatgactaccaacaccgtgataccgagcctggctgctaccaacgcatcaccctgcaaggacacccaggtacctacctaccaatcggtctaatgcgctcaaaatcatcatcgcgaacaggtccataaccgacatcggtgatgacgatcttttacacggctttgccttccgcttgtgggccggtgtacatacgtcgccaacgtaacaaggttcaatcgggccaagtccaagtggagtcttgatgatgctttgcacctacctgtttttcgttctgctgagccaacctaattacatagatcgcatctttggaaagccttggttaccaatgttattagcacggcatcgatcgccaacagccaaagcaaaggtacgatggtgaagtcaccgccgccaacccaaggaacgtgtgtgaatgtgaatggttccagatcgaacacccactgcgagaatccagccaatgaaccgatcaagtaaaacgcgaagaatgcgatcagcactacccatggcacaggagtgaaccgccttgctaaattcagcaattggacttttactgcggtcaacaaccagatagcggtcagctgcacggtcgcggtgccggccattatggccaccatgccgtcgacgttacccgctgtggcactgtagacgagaacggacgctagtctctgcgaccaactttgctgccgaggatccaaccaaattatcgcttaaataatttgctagacaacgggttcagaaaaaaagaactggccacgctatctcggtacgctgactggattctttctggtgcagtcgcagggtaagcgaggtggtgaacgcgtcagcaaccatgcccatcattgtgaacgccaccgcgatgagcaagtggaacattcctgctttccggatgtctgccgctctaaggctgttgttgtagatctgcccgtagggggtgtgctgggtcgggctggccatgattgatggaatccgcgaattcggcatgggcggcctcagttaggtagatcatcgagatgcttcccacatacacgctggccagtggcggagacagcagcaacacccacaagcggcaacacgactcgatcacgccgcagatacagccggtagcctcccaagcgggccagagaagtttgagccgactagcgggcgccgcgtgcgccagatagtgcaatcgatccagggttgcggtgctcataacgtcgaccctctcttaccgctatgttcgcgctggtcggtgtcttcaattgtctgaaatgttgtagtggcgcaagaagggttttttaagaatcggtggctggcggatcaggctgcgtacaccggcgtaaccgaatatccggatctagttcctagaggatttgactgttgacctgggcgctcagcgtgttgccgtcgacgctctcgtcctagacaccctggatccagtttatattttccaggatcgcagataatttcggctttgatcgaggttcggctcaggtgccgcagagaggtcagagaaccgctcttgacgatcttactggctcggatgatggtcactcgtcggcacagtgcctctggttcggtcaggatgtggctggacaacagcatcgtcacgccgcggttgcacgcttcggcaacgcaaatgttcaaacatgttatccatcaacgagtcgaagccggtgcccggctcgtctaagagtagtagtggtagtcgggctcgtgaggaaaaggaaagaaatccgtgaagtctttttccagttgtttttcgagtaggtgcgtgctttcttatgtgggtcaaggtcgaagcgctttagtagctcgtcgcgctaactctcgtcgatgccgccacgcatgcggtccagcaaatcgatagtttcggtttcggttagcgaagaccacagcgtgacaattcctggcacataagcgatcttccggtgaaattctacggggtcggtccaagtgtcgccgccgagtagtagtagtagtgttttcgctgtcagtattagccaaaaccagtaggatgtggatggtggtacacttctcggtgctattaggtccgaggaagccgtgcatctgtcctgtgtgcaccgttaggtcaagttcatccaatgcacacaattaaacaggaactcttggtcagcttacgatttcgataggttctgagagctggtattcgattctcccgtcaatcggtcggcgtagatttccagtggagggcagtaggatttcgcgtgcatagtcgcgtagtaactcacgcagttccgttgaattttcgtgtatatgcagatacagcaggtagctactgctacccgttatcgccagatactttgccctggtttggggatcgcgacttggcttacgcgtttcagatgcgtacttcctcgtcaaggtacactttgtcgtcatccattattttgtgcagcaatatagttgctcattcatcgccagattgcatacttgtgcacccagtaggttatcagcggtgtgtaagacttgacctcggctacttgcgcaagccatgtcgccgggttgcggactacatcgctggccgacttgccgctgcagacctctttaacgaggtaggcatcgcacgctttgtgacggccgtccttgaagccgaaagtggtggatgaccagcgacgcgcctatccccctgcttcggcgatggcgcgcaaactggcttcgaagttgtgttcgccgaacaactcgatgactgcatcgcggatccgagcggcagcggtcagatcgactgaacattgtgtgttggatgctaaacgtgcgttcagttctcggtcaatgatgtggtgcgttaggaatccgtaaaattggttattcgcggactgcggccagcagcccatcgccgagtggcaccagcgcaggggtgagtcgctcgttttcggcgatgagtcgggctgcctcgcgaaccgcggtcacctcggcatcgcgtgccgcgggatcaccggcccgcccgcctaacgccgctcggtgcaccacgatgatcccgcaagatcgcagcagtcgcacgccctcgacgacgtaagccggctggtcgatcgggtcggcgtcgatgaacaccaggtcataggattcgtccgcgagccgggtcagtacatcttggccgcggccgctgattagccgggtacgcgacggcccaatacccgcctcggagaatgcctgcttggccagccgcagata

SEQ ID NO: 25 - DNA (genomic), 37030 bp, MYCOBACTERIUM LEPRAE; double-stranded, circular
  hypothetical: NO
  anti-sense: NO
aatttctggtcgttgatcaccagctttttatcgaagacggcactgttgctgagcctggagaccgttgtcacgagcaccgtgctgtgtgtgctgctcgggtgaccatagctgatactggctcgctgcgcggcacggcttgtgcggttgctgcgactgctgattctgctgccgctggtgttgcccccgtggttagtggcattgcgttgctctaatgcattcggccgactcggattgatcgggcgttgtttgcaagcctccgacattagcatagcgttcaacaagactgctgtggtgatggcgcacactttcatttcgttgtcgtttctggggatctcccacggagatgttgcccgtatcgttggagccgcttatgaatatgaatgtggtcgcttatgaatatgaatgtggtggcggttatgcgcggggcgcgacccaacaccgtctggtggtgggtcacgttgtcgctactgtctgggatggcgtcggggcagtaatggcatttgccctttcgctgggggagtttggcgcgacactgaactccttgccggctcccggcaaggagtcactcgcacgccgccgctcgaaatctaactacagcgggtgaccgacgcggacccggctgtggcactgtcgatcctgcttgtggtaggggcagcgctggtggtcctgggcttggttgttcgcggaatgaccttggccgatacgaggtagccactgtgagcgagttacagcttccgccggtcgtgacagactgccatctgaatgtcgagttctcggtagttccgggcgaggtgcttgccgtacttggagccaaaggtgcgggcaagtccaccgccctgcaagttatcgccggcctgtttgccccgtagtgggtctggtgcgcttgggggaccgcgtgttgaccgacactgcagccggggtgaatgtggcaacgcatgatcgtcgggccgggttgcttttgcagtatccgttgctgttaacgcacattcatgactgtcacggccaacgtggctttcggaccgcgcagccataacaagatgttaagcatgctacggaccgtcggcgtccaggacaaggctctatatatctatcggggtaaggcatatatctatcggggtaaggcgctagggttggctgctccaggtgaacagctgagcagggcgccgaccgcaaaccatggcaactgtcatgtggtcaaacgcagtgggtcgttattgtacgcgcattggctgcccaaccggaggttctactcctcgacgagccgctaactaggcttgatgtggccgtggccactgctatccgcccggtgttgcgcagcccggctaaccccgaagcggctgcgccatcatcctggtaacccaccagctgttgtatgtggtcaccatggccgatctgaatgctagtacttgagtccggcaggatttccgcgatcgggaaggtcgccgatctgcttggtgcgtcgtgcaatcattgcggcgcctggatcgcaggcgtcaaactggtcaatggaaccgtcggtaccgacggttcgcagccgctgtgttcgcgcctaccgcggttgccgttcagtgcgattcgtcgcatggacagcccacgcactaccgtcgaacttactgtggtggcattagatacctcggggcggggggagggggactcgcttgtccttggttcgcggtccgaagcaaccttatggggctcttagcctggccgcggaaatcatcgtcgacgccaacacgggagttacggctgatgcccgaagagcgtgtgtgggtcaatgtcaaagctcataaagtggcgttgtactcggcgctgcagcgatgcgtccaatcgtgaaccggcacgtctcgaactggcaaaccggaaaacccccaccgcacataagcaagccgtccttgcgtcgcagtagtaacacggtaggttcgtcgccatgaatcaggttgacctggactcgacacatcgcaaaggattgtgggcgatactggcgattgccgtggtggccagcgccagtgcctttacgatgccgttgcctgcggccgccaacgccgatcccgcgcccctgccgccatcgacggctacggcagctccctcacctgcgcaggagatcattacaccccttccaggcgcccctgtctcgtccgaagcccaaccgggtgatcccaatgcgccgtcgctcgatccgaatgcaccatacccacttgcagtcgatcccaacgccggccgaatcaccaacgctgtcggtggatttagcttcgtccttcctgccggttgggtggagtcagaggcttcacatcttgactacggttcggtgctgctcagcaaagccatcgagcagccgcccgtgcttggtcagccgacggtggtcgctaccgacacccgtatagtgctcggccggctggaccaaaagctctacgccagtgccgaagccgacaacattaaggccgcggtccgactgggctcggatatgggtgagttctacctgccataccccggtacgcggatcaaccaagaaaccattccgctccacgccaacgggatagctggaagcgcctcctactacgaggtcaaattcagcgatcccaataagccaattggccaaatatgtacgagcgtagtcggctcgccagcggcgagtacccctgacgtggggccctcgcagcgttggtttgtggtatggctcggaacctcgaataacccggtggacaagggcgcagccaaagagctggctgagtctatccggtcagagatggctccgatcccggcgtcggtttccgctccggcacctgttggataggccatccgacatccactccgctgccactgcggaccgtgtttccttgacccgccgcccgcagagcaaaccactgtcgacaataggcactcatcggtgtatacccacattacagccccgcatctgcgctgagctatgccatcgagtgcaaggagattacacatggacgtcatggcagctaccgagtacctcgcccgctcaacgacgttgactagtgttggctggattggttacatcattatcggtggtatagcgggctggatcgcaggcaaaatcgttcaaggcggcggatcgggcatcttgatgaacatcgttatcggtgttgtaggcgcgttgatcggcggctttttactgagcttcttcgttaacaccgctgccggcggttggtggttcactttgttcacttcgatcctaggctcggtgatcctgctttgggttgtcggcagggtacgaaagacctaacttggctgtgatgacttcaactggtcgccggcggatcacgacatgatggcgtgatggcctcgaaagtgaccaggatgatgcatgcgtggcgggtgcgtcggcccggcccgatacaaaccagcccgctcgagtgggttaccaccgaggtgccgtgtcccgaaccgtctgaacttctggttgctgtacgtgcgtgtggggtatgtcgtaccgatctgcatgtcgctgagggtgacctccccgtgcaccgcgagcacgtgactcccggccacgaggtagtgggggaggtcttgggggtgggatcggacgtggatgcggccgctgggttcgatgtgggggaccgggtaggcatagcctggttgcgctacacctgcggcgtgtgcaactattgccgtagcggtaccgagaacctgtgtgtgcagtcccgctataccggctgggatgtcgacggtggatacgccgaatttactactgttcctgcggctttcgcacatcacctaccgagcggctatagtgactgcgagcttgcgccgttgttgtgtgccggcatcatcgggtaccgatcgttgctgcgatccgagttaccgccgggcggccggttaggtatctacggctttgggggcagcgctcacatcgcagcacaggttgccttggtgcaaggcgcagaggtgcatgttatgacccgcggagcccgggcgcaggagctggcgttagaactcggcgctgcgtcggctcaaggcgtcgctgatctgccgccggtaccgctggatgccgcgatcgtgttcgcgccggttggtgatctagtgctgcccgcgtgcgaggcgctgaaccgcggcggcaccctggcgatcgcagggattcatctttccgatattccgcagctgaactaccagcgacacttgtttcaagagcgtcagattcggtcggtgacatcgaacactagggctgatgcccgtgcgttcctcgacttcgcggcccagcatcacatcgcggtcaccacgccggaatatccgcttgagcaagccgatcaggcgctgaccgatctcagcgtcggccgcatctcaggcgctgctgtgctgctggcgtaaccgagtcaagtcgatagatgccagaccaacgcagctactaggtcacccaattcgttcagtgacccatatagcgctatcggctcaagaggctatcgctacgtcggcgcagccagctgaagaggaaccctgctaagccggtagccggcattgccagtgttaccccggcgaacattaggacgatcccgtagccgagtaaagtctatattgctgttcgtcaactccaacgtatgtcgtgacatggcaaagatcaaacggcagtgaggttgcaaccataacgctacggaatccccaggcccggttcaacgtgccgtgcagtacatacacctcgaggggccagcttttcagggatcacggtttgcagtgtaatgaagaccatcgaggcggtcagcgtgccggatatctcagagatccgagcgtaatgattgttcatgaacgtcagccgaatcatcgggaacaggacaccgacggaaagctattaacgccatgatcaccacggcggccagcgtataatttacgctggacttccagttttcccgggcaagacccaattcagcccagttgaaaccattgcagggcaccgacgtcaccagtacgaacgcgccaatagggatggtagtgatgcttgcctatgtcgtggttaagtgcgcgatcaggttcgttggcacctgcaccagcacccacgatgacggcgacctggttccggaactggtgcagcgccgagatgcgacattagcgggtgggtgtcaactttagtcgtaatgacgcgcaagacgagttcgacggtcaccttgttatcggagtgggtcggagtgggtgggtaatcgatcgtgatcatgtcgccgacgcgcactgttgcggacgatatcacccgtacgtaggcaccaggtttccccgcttgggtgaaggtcttgatccactggctcaaattcaggcatccttgaaacttgcgacacagtatcagcggcgttgagacttccaagcgccttccggccgccgcgggttggttgagcacattggcccagtgcccggtgcgtatccggatggtaaacagcgggtgttcggcagaagtgagataaccgaccgcgtagacgtcaggatcgttggtacgtagcggatgcgtcgacgagcacacgccatcgctatctattgatagcctggcttgttcgacgagttcgatgttcggtttggtgccgacggccaccagcaccgcatctgcggcaaccgtggatctgtcgcgcatcttgaccccagtggctttgtcatccgctccgtcggccctggtgatttcctcgacctgcgtctgtaactgtagattcactccgcgatcgcgatgcagggcggcgaacatttcacctacggttttgtgtcgagcgcagccaccagtgattgtttggctgttttgacgacagtgacgttgaccccgcgctgcaggacggcggcagccatttcacaacacaatctacctacttagttgttcccagcacagcgagagaatacccttcgaaaagaacagaattcatcgactaagcatctttatttaggtgtgtagatagtggactccggccgcgtcggatacaggtatagctgggtgccgcgacgccgatctggttgccaacaacagcttgtcgtcctgcaccgcagctccgtcggatagcccgacggtggtatgtggcatgatctgacgacaatactcgtgcgccgattctcgggttgacatcgtgttagcggtaccgatagaccgtctggacggtgaagctgcttggtgactttttgccggccggatgctttttgttatggcggagatcgctcgtagggcagctgttgctcctcggtgagcgcagtgacttaccgttaaagtcactgtcgtgcaacgtttttactgctttgcctccagcaagtcctctgccaacaatgacgaatgtgatcgagttggctatggtcgctgctccatatctgttgtccaagcccccctagtctactacgggatggagtcaaggattatccggccacgtgctgggttacgtcgtggtcgagcgtcgacctgactagattggcagccagacaagcatgagtgcgcggtgccaaggtatccagttttgccgggttgttgggcagtcctgatattttggttgtcgctatggcgcgttcaccgaagtacggtcgcaccctgtccatatatcttggacttcgtttagataaatgtcagcactagttattgctaatccctttcaacttcttgatagagttgcttcgcttagccgtaggaacatcgttgcggctataatgggtcatttagcgaagattattcgtgtactcgtcgtggatgtgctacgcgatgtcggtcgctggaccgggctgggtggacgagctttcgtcataacgcacttagtgagcccgaccaaatgcgctgatcatagtacgctggccggatgtcagcacggcctgctgcgtacgcaggccggcttcgaacagtgcctgcgcgtcgcgcaccgccatcgtcgtatcaatcggcttgctagcaaacatgcacagcaccagcaaccggatcaatggcaagccaatgccgctgatccggattcccgcttcggccgagtatgtggttcagttgaccttcagcagtcgtcgtacccagtgtgctggttgctgggtacgacgtaccccgtaccgtgatgcccatgtttacaaacatatggcaccgtcctggtggacgtaaacttaccgaaggtattgttttggcttgagtgatctcgcatagtctgctccgcaactaactcaggattgcagtttgcttttggtcttcacttcgtccgcgtcaatgtgtaaacaacctcgggcttttcgaccggccataaccatcgagctgacatgttcccggtcaagcagctgctcggtgtttttttggcagcaccagcaaccctccctggccgttaacagccaccgattgtatggctgttaattcataatgccagcccaccgaacattcgcttctccttgacgccgcgttccggaccaaacagtttgctaatctggttggctagatcttacttttgtgcgttcgcacagcggtgttagccttgatgttgtagacgtaatccgaatactcgctgttttcgcaaaccattccgaactggttgtctaccgggtgaacaccggctgcggtccgccacggctgaccagttttacggcgaatagtttccagcattgtcctcggcagctggtgacctaatgaattgaccaccagccattgaatgctgtaaattaccttctgtttcaaatcccacaaattggtcatgactgtgattgtctcaaatactacgatgacgcggcggcaaacgtgtgtcggtctgcgtttcagcgacacgctattcctggcgttatctgccgggatggaaaacgccaacgaaaatatcaacccagcaatgtggcagcgggagctgcaaagtgtggaggaggctatctgaaagcggttcgagcttgacggacgagttgtgcaaccatcgtgaccaggatgatcccaaacaggggttcggtagtaatcgtcgaaaatttttaggaaacaatcgatttatgtcaaaggttgagcacgcgacgaagtctgcggtcgaccttcgtacatcaagcccgacggtatttccctgattagatcggctttgtgcagagtaacaagtgcggtgacgttgacgaccgagtcgtgtggcaatcctgctatggatagtggttaggaacatgctgcctggcatggttgctcgccttgtacgggccggctatcacggcggctaacaccgcgataaggcgactggcgttgtacaaatcggattggatcgcgaccaccggacgacgtttgccaggtccgttaccagagagcgcgccgagatcggcccagtagatatctaccgcgggtgatcatcacccgcgtggtggctgtcgggcaccaggtgcccgacagccaccacggcggcttccatgtcatcgctgtcatcaggtccataacccaggtacgccaaaacgttgtcaatttgtctggtcaaagattggccgtcccatttgtccatttagcgctatgcggctcgtgtgaagaactccgaccggctcatgcggagatcacgcgcttgccacgaaacgtgatcgaacgtatcatctggtacggaaattagtggtcttcatagtctatattagagtagagctcgctccgaacctaacgagacgaagcccagtgagctctgcgatgattgaggctggttgcttcgatgcggggtaagaaacactgcggcgcccgcgtcacgttagttacgtcatgctggtggttcaatggggcccagtcgctgtagttgcgtcacatgtctgggcgagagttcctctaaacaggtcacacctaaaagttgcatcgtgcggatcaccccgctttccaggatttcgatcgcgcgcctgacgcccgcttcgccaccggccatcaacccgtagaggtaggctcgcccgaccagtgtgcaccgggctcccagtgcaattgctgccacaatgtcagcgccggacatgataccggtatctaacagtatctcggtgtccttgccgaattcacgcgccaccgtaggtagtagatggaagggcaccggtgcccggtcaagttgccgcccgccgtgattggacaacacgacaccgtcgataccgcgctcaacgacggcgcgagcgtcgtcgagcgtctggattcctttcactacgaacttgccgggccattgggttttaatccacgccagatcgtcaaaagtgacgctggggtcgaacatggtgtttaagtaatcgctgacagtgcccgaccagcgatctaacgatgcgaatgccagaggctcggtagtcaacaagtcaatccaccagcgcgggtgtggcagcgcgtcgaacacagttcgcagtgttaacgccggcgggatcgacatgccgttgcgggtgtcacgtaaccgcgcgccggcgaccggaacgtcgaccgtgaccagcagggcatcgtaccctgcgtcggcggcgcgctcgaccaacgccattgagcggtcacgatcccgccacatgtacagctgaaaccatttgcggccctgcggaacggcggccactacatcttcgatcgcagaggtggcgagagtggataacgaaaatgggatcccggctgcagcagcagcccgcgcgccggcaatctcaccctcggtatgcatcaaccgagtgaatccggttggcgcgattccgaacggcaacaagaccgaatgcccgagcacatcccatccggcgcatacgttcgtgacatcacgcaagatagccgggtgaaactcgatgtcgcggaaggcttgttgggctcgtttaatggatagctcgtcctcggcggcgccatcggtatagtcgaacgcggcctttggggtgcgctgtttggcaatgcaccgcagatcctgaatggtcagcgcggcctcgaggcggcgtttggtcgctccgaatttgggccgtttgaactggatcagcggggccaggtcgtggactctgggcatccgccgtttggctgccatcgtttcccatccttactgtggtcgacccatgctcgcctgggcaatctaacctatgttggttgcaagatctaccagccgtgagcctcgccgaccaccgagccgacgatctcttggggcagtgttgctgatctggcgacaaagtgtgcttgcttggtgaccatctcagccagcactaggtgcaacggctcgttgtccatgttggatgtgaccagcagtgcttcccgcagattccggccattgcgtagctgatagacgtagttccggttgtccagccgcagggcgacagtcgatgcagaagtgcagctacgggtggcgccgacgcagcccgatcagatactggtgcagcgcccacgcatggacgccgaatacatctaattgcattgggggagagaagaactccggaagtaccgcgtcgtcaacgccgtagcgttcttccttgagaccgcgaaacccgaactcgtcgccggcgtacacgctgggtacgccggcgacggtcagcaagattattagcgcatgggtcagatgttcaggctgtccaagctggctggcgatacggctcacatcgtggttacagctgaagttcagcagcgcaaagctcggcagcaacttgttgtttcgttgcagcgcctaacccagctcgatgaagttgccatcgctgcggctgctctagagctctttccacagctcgtattgggtgacggagttgcatccggcggagccggccacggatgcataatcgctgtgaatgaactcgccgacgcaccaagcatccggatgcagttcgcagacttttggtactgttgtattccagaatacttgctgtacagcataagttgcatttagtcgctaactgtcagcgccacgctgcaatcagtgccccatgccgttggtgacgtagtctgcaaccttcgaggttatcgtggttgagggtcacgaggccggagtgccccttgagcgtgtgttgagtgtgtggaaacgatcgtgctccccgaaactagcgtgccgacgccgctgttgtgcggtgcattgcggatagtgtttccagtgcacgctgacgtcattaaacatgctgtcgagcagaacacgcaggccccggcggtgcgcttcggcgagcagttagtcgaagtcggcgtcgtcaccgagcctgggatcgatacatgtagtggtcggtggtgtcgtagccatctgtgactcagggaaagatcgattccccaacgcaatcccagatgcccccgaatattcgatggtgtgatcaaaccagccgaccagcagccgcagctaatgagctaatgttcgcctgggcccggtaggcccagtgacggggcgcgaggaaggggcctaagaaacccagcgtatagacctgctaccagaatcacattaagtggaaccgcgtgggcaccttcaccgcgctgatgatcagccgatcgtggacagtatctcagcggtggtaatccactgtgctacatcggaaacaataactgcgtgaccttacaacgcttccgataacgcctttcgatccgtacctgcttcacgcagcgtgtgctcatggtctacaacgcagtgcgagcacccattgatcggcgataccgcagaggactactgctcgaaagcgtcttgtgtcgactcccgggttggcgatgatattcatccgcaactcagaatgcagatcgccatgttgactgtcgaggaagccacggccgaggtagaacccggacgaattggctgcttcggcggtcgactctagggtaggcatttgcgcgttccgcgtcgctgcaacgttatggaacagcgtgccctatagctgcttctcgttcagtacggtgttgcgggcgattgagcccaggatgagcttgaagttcttggtgtactccggcagcgcgaccttgaggtcctcgatgctcatatgccttccaatctaagttggagatcaggcctgccccggtcaggctgacgtcttgagcaattcagtcgcgttcagagtcgggtcgcccttgcgccagttgcatgcacacagttggtcggattgtagggcatcgagcacccgcagcacctcttccacgttgcgtcccacggaacccgcggtgaccgagacgaactggatatcgttgtcgggatcgacgatgaacgtcacacggtcagcaacaccatcggcgttgagtgctccgctggccgcagaaacgtcccgcttgatgtccgagagcatcgggaagggaagccgcttgaggtcctcgtgctgtgcacgccactggaagtgcacgaattcgctgtcgatcgaaactccgagaatctgcgctccacggccttcgaactcttcgttcagcttgccgaacgccgcgatttcggtcggacaaatgaaggtgaagtccttcggccagaagaacactacgcgccacttgcctgggtggctgtcactggagacggtggtgaagtagtcaccaggctgctgtgcgtcaacctttgataagtcgccgccgatcagcgcggtgagttggtaggcggggaactgttggccaattgatagcaatgacatatccgatccttgtttggattgattcaaaatcagatttttacactatccttcaaggttgccgtgagtttggtctgaagtaaaggtgatatatcacactatacttatcggtatgagtgataagagttatcagcccaccatcgctgggcttcgcgcctttgtcgcagtggttgagaagggtcacttcagcgccgcggcaagctttctcggcgtgaggcagtcgacgttgtcgcaggcgttagcggcgctggagtccggacttggtgtgcagctgatcgaacgttctacccgacgggttttcgtgacgacgcagggtaggcacctactaccacgcgcccaggctgcgatcgaggcgatggacgcgttcaccgcagcagctgccggcgaatcggatccgctgcgaggtggcatgcgccttggactgattcccaccgtggcgccgtatgtgctgccgacgatgttgactggactcacccatcggctgccgacgttaaccttgcgagtggtcgaggaccagacagagcacctgctgaccgcgttgcgtgagggggcattagatgctgcaatgatcgccttaccggttgaaactgccgggattgccgagataccaatctatgatgaggattttgtcctcgcgctacccccagggcatccgctttccggcaagcgccgggtgccgacaacggcactggcgcaattgccgctgttgttgttggatgagggtcattgcttgcgagaccagaccctcgatatctgccggaaatcgggagtgcaggccgagctggctaacacccgcgcagcgtcgttggcgaccgctgtgcaatgcgtgaccggcgggttgggggtgacgctgctcccgcagagtgctgcgcctgtcgagtcggtgcgtagcaaacttggacttgcccagttcgctgccccctgccccgggagacggattggtctggctttccgctccgctagcggtcgcagtgcttcctatcggcagattgccaagatcattggtgagttgattagtacagagcatcatgtgcggctggtcgcatagcagttcgggtaccggcaaaccagagatcgtcctcatgcccatgccagcgacggtaagctcgccctagtaggaaaagataatcgccctgcttatgcgtgctgagtccgatgatggttggtacgctcccaggggggcgcggtcgccgatgcgctgttgggttcggtttcccgggttcttgatcgacgtccacataatagcgcggttcgccactcaaattcatgacgtttacaacgttgctgctggtggtgactctgtggactcagcaatgctctgctgatcagacggcgatagcacttaagtggctggcttaggagtgcgatcaactcggcgtgtatttgatgacagaatcgatcccactgacgccgattgttactgaatcatgtattcgtacaacgtgtttaggaaacattgttctgccatgccagttcattcccctagaacagggggacttgactgggtcgttggcaacgtggccacacgtaggtgatcattgagatatagctgacatttgggtacatccaggctggggtcgtacgtactctcacttcacactcgccgggaagcacgggtaccgtcaaagagttgttcctagcggaggcgatcatcggtctgaaggctttcttcgaggacacctacgacaacgatctgcaacatgggctaagctgagcaattacttagcacaactgcatttggcgtgaacaaaaatattgacgttgttccaactagctgctacatgttcaagtcaccgtttcagatgagcgaggacctcctaggaggatactaaacaacatttaactaatactgtggcgttcgcagcgatagaaaacgatctagcggtggtctccacggttcactctggcgaaacggtgcagacttcgttagttaatgtcgtcctgttgccaaaccccgccagtggcgaatcctctttttataggttctaccgcctggaggaaagtgaaaatcgccaatctgcaggcccggtcgtagctggtcataaccttccccagcgaatggcagtgggggactgtcgatgactgcacggagcgggtcggatgagacacagccgtgactggccgatgccgactaattacagctttgtactctaaaaatttaagttcaaggtaataaggtttttaccgctacgagcggcagcaatgacagctggcaagagtacgaccgaatgatggccaaaggaacggtgtgctgtgtggtgttgatcgcgcgaacgcggatgcacggcaacggttaaacatcacagcgagagacctagtgacggggtcggcgggctgcctggctgttgatgccctcgggagatggattcacgcctacgaagcgttgcccatggggctggtctggcgggtgtgcgacccggaagttctgctgtctgaagcctgccgacatgccgaatccttgcctccaggccaatttcaagttggatggcagtcaagcaccacgaggatcgaaccgatctgtgctgagatcgccgcagcgacccgtgcgaggaagtcctcacttcgctgatctgtatgggcgttcaggccaccgccgtagcttgagtggacttcaccgaccgccacgcaatttgacatattgtttagctggtcgggttaagtcaggcttcacagtcgggtttgaggcggcgatgatcgcccgcaatgtgcgtcggcagcgtccgcagtcactgcccgctccgcaagcggctgctatctccttggacgtcgtcgcaccacgtgcgacgacatcgcacacagtttggttggtggcaccggcacacagacagacgtacatcagcaaagttcccgaccgcaggtgacatgcctcactagatgcgcgctcatcgtatctcgcttgattagaaacccaggcgatgccgtcgggcaaacaggtcgcatattagtggagtctaacctaagtaggcctaagtaggtttttagtgcagtctcgtctaaaatttaacgtagtgacctgcgattgatatggtggcttgcacgtgatgcgccgacagtgcactaaaatcccacactgacccgtacctgctgtactagatctgacccaggcccggctatagtgtattgttaccatagtgtattgttatttgtgaggataaactaaagccgaggtgtgcttcggtccacctttagcggttcgacatgatctcttacccacgttataggagtgttcatgcaaggtgatccggatgtcttgcgcttgcttaacgagcaactgaccagtgagctcaccgctatcaaccagtatttcctgcattcaaagatgcaagaaaactggggctttaccgagttagcagagcgcacccgcgtggagtccttcgacgaaatgcggcacgccgaggcgattaccgatcgcatcttgcttctggacggcttgccgaattaccagcgcatagggtcgttgcgcgttggtcagacgctgcgtgagcaattcgaggcagacctggcgatcgaatacgaggtgatgagtcggctcaagcccggaatcatcatgtgccgggaaaagcaggacagcaccagcgctgtactgttggagaaaatcgtggctgacgaggaagaacacatcgactacttggaaacgcaactagcgcttatggggcagctaggggaggagttgtactcggcgcaatgcgtctcccggccgccgagttaaccagcccgaggctaacctcgctagtccactggtaagtataacgtacccgcgagcagcggaccgcggacctagtcgaggctcacccaccgtgcatcctgcgttcggtagcgcgctgatcgggctgcggtgacggtcgtgctgttatgtggttgtcggaccactctggctagccgctgtacgacgccgactaattgtggcttcccccagctagggatgtgaccattgaactacgtgtgctcgctgctgctggcctggattgtcgacaagctggtccgcctcgatcagctaccagggtcggccgggctaccgtgaggtcgaagctgccctgcaacgcttcgtgcatcgggttatggtccaacgtggttggcacgatgattcgttgactatggctctcgggtgctcacaggcagcagtcgcaaaacgattctgcggaaatgtgcggggtaatatcacgccatgagccgaatcggtacatttgcggatgacgatttgacgggttggattctgcatttgcccgatcttggccgcgttgcccgggttcagtctagaggcagtctacaccaagcactggctgttgacacgcacgcgaactggcacgagcggtgatcgcccacgacgacgaatgcgtcgtttgcgtaaacactgcacgatgcagaaagtgctgccgaaggggttgatgatgaagagttgtacggccgcgtgatggagtggcttacctggtccggttacagtggacgggaggggttgaccgccgaggccgcccaccagttcgccacaagtacttctccgacgagttgttcgttgtcctgactatgactatatcgtacacgctgtgtatcggcccggggcgggttctgcggactctggatataagggatattaaggcagtcctgcaagctgaccttgcccagccagggtggtgtgacccgcactacctgtcgtcagcatggagtggccagttggtgctgcagccagttggtgctgcagaatggccgctatgacaggttaactcgctcgctgctgcagagcttgtcgccccactgaatacagaagtgtcgccaccgccatagacctatccgcactacgcatcatcggcgacaggtttgtctgggggcgcccgccgcgtttttcgagtaggacgacgtaactatttccgcgtgcagccgcgtgacgttgagccgggttgaggctgctgcttgttgcagcaggaatcgacgcggtgattggtcgagaaatcgaattcctgctagtagatccaggcggtggccggctgccgtcagcagggtggttgtagtacggtcttctcgagtttcgggattaagtgattgctgcacttgataattcgcagttaatgcgagatatgcatcggcgatcctgcaatagacatggtggttgcgttcgtcttatagggcaggagcgctacatgctcctgagtcccgagcagctggcgtatcattctggctgtatggtctgggaacttgtcgtggtgtttgatgtattggtcttagcgcaacatgtcggcgaagtggtgttcattgatcagtgtgtctaaggctgctaatttcccgcagggactaaagacgattcgaaaatgctttcaacgagactaacaccgaacccaccgaaccgcttgcaaagttcgactctacgtccaattcatggatcggtttcgttgtttgcaccccctgcagccccatcctagatctggttaaacacattgatctccaggttgtattggatctacactgccagttcagcgaagtcgaattgactcggctgttttgccaaccgctagagtgaatgactgactgatcgacaccggaatcggcgagggtatagccgatgcttttgatctgaacgcactgtttggaggttctgtgcactaggtgatttgtcttgagtaggtagccgagcaggccgcgtagatgtccggtgcctacgcatcggtgttcgggagggggattttgcatccggagctgagctacctcggtagtttccaagtctatcctggcctactgggccaggtgtgacggccacttgaccgagccataagtatcacaagctgttgagaacgcaagccgcgtggtgcgctataccggtagtgtttgtctatgcgtataggaggctgctgcgttttgtgctacagcaagcgttgcgacttggcaagctgcttcaattccatttcggtttcgaagaccgagactgtggtttatacaagagcaatccactgtatattcttgactttcttcgacagtctgggaaactcaataatttttctgtattgctacttctatcaatgtgaatcttgctatctggaaaaggattttaacaatttctatctcgacggtgagttgagaatgaattacctagaggctcggccaccaacatttatcgcctgggtgattgagatggcgtctttttgcaggatcctgtacccgtcgtacgggttcggtcccgcggaactctactttctgggtacagcgctgtggcgcaccggcatgcaccacttactgcgtgtatttgcctaggacggtgactggagcggggccaacaccattgaggcgttgccggctgttgctcatggcaatcgcccacttctaccgccttgacaaaaagatcgactgaaaagagatgaaccgacgcagcttgctaccgatctgatggtgttgcggactgtcggccaattgaatctggatcgtctgttacgacaactcccaccgtagcggcgtggcaatcagcgatgaagacaacacgtccggatccggttcacctatactacgataatgccggttccgacggcggcatgattggcatgctatatctgacatacgagaccagtgtctaaagcgtgacgaaacaccatctccggcaccgtcgttatcccgtagcagaagtctgatttgcggagcctaccgatatcggaaatccgtgctaaaccgctagcataagttgcactggccggtcgacgatataactcgattgccaaggttgtagcggataaacgagaagttctggttacttagtctggtagcgggtgtgcgggctactggttcgtcggagccaacccgtcggcaattgttgtcgacacgatcaaggacgacttcgcactcgcagctgtccagtcgcagtccttgaccgcgtccgcatccgactgcatgtaacccgacttcggttgaacctcatcgattgtaggttggtgcttcccacgctttgtggagttcctgctgatcctcatcaaggatgaggatcagcattgctgcttgctcggaccggctggatttggaggtcgccggccatggctgcacgcgcaaggctccctatagccatagatccctatagccatagaatagcaccacgtggccgccaccgcggcgaacacttcgtcaaacgttgcacctgcggctattacgatagtctgcattcttggggtagtcggtacatcaaatagcggagtcctggcgtgtcgtgggatgtccagtctagagcacggcaagcggcacatagtcagaagcccttgatcagcaatgctcttcgcgcacttagatgtgccagactaagcaagatgccgagatatagacacagcgctcccggtggaatcacccgagctgaagatctgccgatctcctacagtagaggaaaaaactttgctgttcactaagaaggcggtcagcgtgaccacgatcgaggccaggtgcggtgatgaagccatcctactgctcgtgagcgtcctgcttttgttatgatcgggcagctacgccaaatctgcggtctatgcgcctgatcggtcaagctgcccctagttgccgagtgtgcaatggtgagtgctcctgtgcgtagagctcgcaactagtgtgtctgatagatttgaacgctgttagcgcgaccaagttaggtgcgtgatgtgatcctcgagggcggcttgtacgtcaccgagatgcgctgtacgcatgcactggtagacggcccgcggccatcgctgcctaagtcaatcgacgagggtcgctgggaccgcacagatcggcatgtgcacctggaagtcattcggcaggagcccaataacggcctagttgatcctgcagcagcttcttccaagccggattggaacccatgttctctatatgtgccagggcgtcagtaccgaaacgagccacactaggtcgaggtctccaggtagttcagaagccgctctccagcggtgaacctccgttcgaagctgttggatggcaacccttcccactgtacgtcgttaacattgtgccatccgaatttggatattatataggcgcgccgctggccgagcggcaaggtgcagggcatgcacgtaatgggtctcttcctcgtcgaggaacacgtggtagaatacattctcggccaacgcgtcaaattaactctcaagcctgttgtctagttttgtagtgtaagcctatctgaaaattgaccctgactctgtcagctttatgcctagcctgcttgaccgccgaaggcaccagctgttgcactaccggctgcgaactaccgatatcccaacggaactatttcccgctcggactctctatagtgagagcctcgaaagccatggtcggtctgattggtcatgagttgcctcttttgtagactttgtgctttactttcttaaagtatcccgtgcgtaacatcttcaattcgagaatgctagcttctactagttgagtgaatcgtcgctggcgtttccgctgctttggtttttaaatgacagccgacttagattcagacctgtcacgttgagcacccaagacgtgtcggctgcggcgagctccgctaagtaggtccacggtgctttgagcggccatgctggccgtgtcccaaatagtccttccacagtgcgacctgcgcactgctgttttcggctaccaggtgaaccgagacatggcgtcggcgccgttgcacaccagcgggctgtcgtgattttggtattctcagctaagcagattcgagttccgaactggagccgcttcacgatatcgttaggccccgagctgccaaagttggaccaaccggaaggtcggcatagatacagtcggccggtaagaacgttttactgcctcctagtcgcgacgccaaagtgcctgtcaaagctcgagtaggacatctcggacggcgacctaggagtcgtctcgcatagtggccaataacattcggttgttgtaccgatgtcaaaaggcgccgctggcctgttcaccaggcgcgacaccatgagactcacagaattcgtcgatcacttaagataccatcgaccgtgtcggtcccaacgctatcggcagtgtcgaccaacctctcagcacccgcgtgtccagcctacttctggtaccagctgcccgcgtctacggtaagtggtcgaagaaggctcgcagccccactgcattgtaggcgcgggtaagagcattttccaaacaaaattcctgtcaccggaaaatgcgagattccttcccgcattgaggcgttcgatgttgaacctatctggatcggcaaagacggacgggtcctggttggctgcggccaaaataaagcaccactacctggctgcgcttgatcgtgctacctgctaggtcgacgtccttgcgcgctacccgagcggccatctgaatcggcgaatcgagccgcaggatctcttaaccgcgtttgtgccccggctcggggcacgcctgtagcatcaccatatgctcaggtgtatccagcaataatattacgaataatacccctgcctagcaggttcaccgtggtttcacccccggtagccaacaccagccccggagattgcctgaagtttgcttttgctgagagatatttcggtaggtttgttgtcttcctagtgactcaggtgacgtaccagattatcgcctggggtacgttgcaactgcggtaagtgtttgagagccaaaagttgaaacccgctacctctcgttatgcctgctggtactattgctatgtcagttcaacgtccaagctgggtgcgaccagttcgccgaacttaagaatgtggcttcggtcgcgatcgggtaccctaaaatatcgctgatcaccgcgaccggaagctgcgaacaataccggttgaccacgtcaacgacgtcatgttggtgggcgagttgatccaatagggctaatgtggtctgctcgatccgatcccgtaacgtggcgactgccttgggcgcgaacagcggcgataccgtcttgcggtagtggatgtgataggctcattgaatagccagcaacggatgcaacaaattgtattggctgctggttctatagccagtgcgacggcgccggcaaggttacgttaagccagaacacgtggaagtcctctgattgcagcagttcatgtgtgattgcacggttggcggtcaaatagctgatgcggctctgcactaacgggcgtcggggacgcggtttgtggcagtaagggcacgggattcgccttgatggccagagcgatatccaagcgggccaacgggtcacttcgccgggtggtgagttgccgcgataccgcggatgaatccatattgtgcgaaccagtgcaaacgctgccgtacagatcctccatcagtcggccggactacagatgctaattcaccagctttcttcagtggaatcccgaccatttgcggtcgggaagaagccgatcccgtctgctcggcccgcgttagctggccgctcttgagtttttgtctgggtggttctacctctccgccggcgtggttactgttaaacaaacgtcgtcgcaagtaagcagtggttcgctgccgattgtcaaccaccagattgcccaacgtatcgtggccgaggctcaacccaccaggcgcagtattgccgttgaagacctgacggggctccgggctcgggtacgccccaaacgagctgaggtgcttttttaggcattcgcgcaactaggccggtttttgagttataaggatcaagccgctaaggttgcgtttgttgaagtcaatcttgcctacggaagccgaacctgctgtgagtgtgggatgagtcgacaaacggaatcgtcgttctcaaagcggctttgagtgtggccggtgccgctttgttggcgcgccaattggcccaccctgacagccccagtcagggtggcagcagcaagaatgtggcgggctcagcgctacagcaggtgatcttgaactctgtggttacgactttgttgagatcactgctgttgatgtcggaggcactagcgggtgataatgtacgtgtttggcaaccctcggcgtttgcgtctcccactccgtctgcccagaagctgccagtgaatccgtcgacgttgcggatcttgacctattgaggaagttgccttgccggcactgaacaagctctacggctttgacttggctgctgctttcgcggatattgatcgtccgctaggatggctttagctgcatgcaacggaatgcgtcgaatgaacgttgtcgtcgatggtcagttgtgtagctcgtcgggggagggggattccgcgcacgccaaggcgagggcgatgataaccacaagtacctcgactactctggactattagttctgcaccagctcgtctcaattccgacacattacggcctttttggcatttggcataagcgtaggtacggacgtggcaatacggttatgcaccaattccgggctagagcctcgagctggtcgatccagcggacgctacttgctgtcggacggaccgtcactccgcctcgaccacgtctttgatgcgccgcagcgtcttggtcatatcacggatgttgcggcgcttccgcagaaaaccgccaagcaaccaatacacggtgagcagtggcgaacggttgaaccgaaatgactcggtcacgtatgtgccatcgccagacgtcaccaatcggtagtgccaattgtttaccggtttgttgcccaacaggaccgtgaagccgaactcacggccgggttcgcacgcggtcaccttgcatgttgtccaatacacgggtccgatttcatttcgtcgaacatgaccacggaatttggcgttgagggctgggccagtcacatcgtccagccactcggcctcaaaagtctccggagagaaccgtccggtgttgcggacgtccgcgattagattccagaccttgtccgcgggtgccgccatatgaacggtcaccgaaccttccatggcttgatctaaacacagttttctgttcgttcataggccgttgagagcgatcgccgctagtgtggtatcgcccatttggatgatgtcgttgatgatctgcttcacgccctgtgcgggatgcgaccacagcgtgatcggcaggtcagaggcggcaccgcatttcggccatgcgtctagcccttgatcagctaaaactcggttggccaccgtgatttgttgctctctggacgcgccggcaggattgccgacaccgccgtatcgggcccagatggttggcttaaattgcagtccaccgtaaaagccgtttccggtgttagctcgccagtttctgccggactcgcactgcgcgaccgcatcccagttaggttccctaggaacggcgttcgccataccagtggatgtggatagtgccatcgacgccgtaactatcccgctgaccacggcggacttcacgaacagcttacaaagttttctcacgtccagcatttctcccggcatgtccaaaacgttacccctttgcaaagcttgtgagatagcttatatatcgaaccgggatcggcaccgtaagcagctcaacgagaggtggcccgtgcatcaggtcagcggggagccctaacaatgcgactgagtcgccaacgagagggtttgctgatagaggccggcgagttggctattccggatgacgtcgtttcgagcggcatcgagttggatgacgcatgctggcgaatacagcaagtaccagttgagcgctatctgggtcggtattcgtttcgttgaaaacatcgatcaacgatcgcgacgttgaaggctccggtgacgtggttggcgcactggatggattgaacttctcaatccatcaccggctgtattcgacggccttggtagcgttgatctggtcaccgaaggtccgtgcaatgtactccggatcgctggcagtcacgtcttcgccgcgcattttggcgagtacttgctggacgtggcttggatcttcaatgtcgccgtgcttgatccatttcaaggtggccggccggctcggcgaccaccaaccgctgtgcggcgccgtcggtcaattcgatcagcaggttaccgccaccggtgctcgcctgcggtgagttggcaatcagcgttacgactagcacggccagcgtgcccaagcacttcgggcgaagtggcccaaacgcgcagcgtcgatctcggtaaatgcgattactagtgctgcccatcagtatcgttggctccttgtgattgtgattctggcccggatggccaaactctgttgagcgtgacccgggaccgtgcaggatccgttgtaggagagctagcttgactgacatacggatatgtagacactgcagtcgcgccgacattaacggcaaacgcgagcaatgatccgaacgtgtgagtggtacgtctctacagtccagtgtcggagcatgaacaaccagcgccatgccaacaacacaaccggatggattgatatcacgggtaaattccgggcgactagttgggcgggcgatcggtgcaaggaccaacagacagggccaggctaaccgctgcggggtacagccatcaaggtgttctgtaggtcgggcttcatggcgttgagctgggctccccagtactcccagctgtgcgttccgtcggcattgaggttgaacacagcgttgtggccaccagcaccgttgtaggcgtcctggaactttaggttgctgccgtgcacgaagttctccaggaattccgcgggtacgttggttccacccaactctgacggtgtgccgttaccacagtaaacccataggtgggtgttgttggcgaccagcttcccagcctgcagaatggggtcgtttcgttgccaggccgggtcatttggtggtccccacatgtccgcggccttgtagccaccagcatcacccatcgccaagccgattagctggggttctatcccctgggaggagtccatcagcgccgacaacgagccagcatagatgaactgatcggggtgataagctgccagtattagggccgaggaaccggccatcgagaggccgaccacggcgctgccggtggatttgacactcctattggcggatagccatttaggcagctcgctagtaaggaatgtttcccacttgtaggtcgtgcaacctgccttgccgcacgctgggctgtaccagtcgctgtagaagctggattgcccaccgaccggcatcacgaccgagagtcccgactgatagtaccactcgaatgcggaggtgttgatgtcccagccgttatagtcgtcctgcgcacgcaaaccatccagcagatacaccgccggagagccgtttccgccgttttgaaactgcaccttgatgctgcgccccatcgcctccgacggcacctgtaggtactcgacgggtaggcctggtcgtgagaacgcgcttgcggtcgccgctccgccagcaaggctgattaggctcggcagagtcgcagctgcacccaccaaaagccagcgcccccaggctcggatcttcccgctcacgtcaatcataaacctaataccccttatcgtatgttgtcggtgctctcggcagaatttaccctgcgaatagcccagatgtcgatcgagacgcgaagcgatctcagttctgtatcggttacccgtcacggataccgcaaccgtttggtcgacgcacggaagccgttcctaccagcggattcttgttcgatgtgggcccatttgcgtcgaacgtgtaggcgcacatatcggctttgatggattgtcatggcaactcgaaaaagctttgctggtgccggtttttccgcggaccatggcgcaggttacgatcgcacgaggtgcgctctggcggcggttcagagcatcgagttcaccgacgagcggctggtggcatccaccagctaacccaccatgccggcacggcctcagcggttgtcttacgccggggctgttaccgctttggccgccgccgcggttattttacgtaactttgctgtacactagcagtgggcttgccagctggcttcgggtgcgaattccactgcacctaagcacgcgcgatgcgttaagtcgctgccacagattgcagaagctgctgtgtctgccataccagcgttcgccaggcggtggcgtccagcacatcaatccgtgtcataggtgcagccgttgatcagcctcgcctccgttgaatcgggaacagaaccgttgaatcgggaacagaacccactgcgctgctggaacagcaaagcgcgttactgtgtgatcccgaactggatccaaatggtcagccaccgtacataacgagagttcttaagcacatccccggtagtttaccgcgatcaagcgacagacgacccgacaaaaacctgtaagtctgagtacagactcgaacggcggcaaagcataccgtcaattcctcagctatctgtattgagctcattaataacgaatcgggcttgatgctatggtcggattggcgaaccgtggactgggagaacattcgttatgagttgccgagctcttctgtgcgcaaatcggttacgtgctcccgcatttctcccgcacatacagtctcccggtgagacggtagctgttgccgatcttgacaatcttgtcgctagtggtcagcaacaaagcggatctggggaaagcggccggcgttcagtgacctcagcggtttgcccgaaccggagcttttgccggcccagacagccttttgaccccaccctgcgctgtgcagcatctcgaacgaattcgtttcgaccgtaagttccgcggctaccggtttggcactggtccagtctaccgtgacccgccagcgcgtcatcgcaatggtgagactatgacccagctgcgcaacttttccggtgacgcaggtccaaactagcaatcaccgtcggatgcgtccataatttacattacaccgttaactctgtgggtcacagaccggactgtgtttggtatcgcacgaaactttaattccatgcccgacacgacggcgaaattcatggccgctttgacatcgcgcgccgttcaggagggatggccggtaacgctgagctccggcatgatcagctacacgggactgatcggcagcgggtacattgtgacatcgatggcgacgagttcgtcttggggtagtaagtcgccgattgtgtctgttattgccatggaattaccggcagtgcccaacgttcagaattaccgctgcttcgccaaggtgcgcatggcttcggcgacgtcgtaatggtggagtcgatgtagtttatgcgtgcccagtttcctagcctccacagctttgtcagcgtcgcgagcgaccgcaatggtctcgagcccattgcccgggcaaactgcacaccaagatggtcgagtacaccaacgttaagtattataacccggccaaccggtcaatgctttggtcttgcgcagcgcgtagcaagtggtgaaggccggagtagcccatcggagtggcttcgacaaaggatcgtttggtcgggatccgagccagcgcattggcgggtactgtcaccgactccgcatatccgccgggttcatgccagctaggtatctttatgttcgcatagcagatgcaaatgtctttgcggtagggggggcagtggttgcagtgtcctccgagccagtcgacagtgacgtggtcgccaaccgtgaaatcttctaccacatcgtcgaattcttctatggttaaagcgatttcgttcccggtggttaacggacacagatgctacacaccgagacagttagctgaacttcgtctcgacccggtgacagcatttcgacatcaggccaaccgcaagggcgcgctagcagtctgtatgtggacagccttagagttagccatcaactcgcctgtttaagtctatgtcctaatgggctacagggtattatagtttaatcttggctatggtttagtcgacttgccaatgcttgaccccattgagccagcccgaccgcagctacttgggtttgccggtcgattacagattcggcatggactcggcgatcgcatggaacatccggtcaatggtcatacgtgctaggttgatcccgatgcagtaatgcacgttggtgtcattaaatcccgcgtgggggtgggattacgcatgatgctacaaggcaaacggatcgtcaacactttctcatcgaagttggctgagcggtaaatcacaaccactcgctggcccttcttgatcgatacgctggataactcgtactactttagcaccgttcgctggaaagacatgaccagggtggcctgtcggatgatcttgtcggccgtggtgccgggggctttcttgcttgtacagctcccactaatcagggaagttggtaaattgcatcatgctctgcatgatgcaatttctggtgttctctttaccggccgccgtcagcataatgactgaaaggagccaaactcgtctttggagagcttgtggccctcgatatcggcctcaaccaggttggtcacgatgacctgaccgagaggcttggccctatcggcggcgatctgcatcgcttacataatcaatttcaccgatgtgaccatggggtcattcgtggcgaacttgggatcctgggcaccaactgtctggtttgaccaatggaatagtttcttgcagtcttcctggggtaccactcggcaggccggcgattgcggcttgccgtgacaattcgcaagacacatgttcaacgaagtcgccggaactctacagatgccgtagccgcgacgatgcggcaggcccactcgagtcaggtcatcacgcagttgctcagcggctcagggaatgaaaccgggcgagatgattttgtgcagccgagtgtactgcgaggcgtctatgttgagcagaaccaacttgcccctgctgatttgctcgtcgttcatgccttcttggtagcaggccagggcggtcttttccaggttggagaaggtgccgctgtgacagtgaaacgtccttgtgcttggacaccacgtcaataatcatcgtcataaaacccgctccttccgattggctgctcgtttcattaaatcgtttcggcttggcacatctcggcgggttcctacaccgacagctgttcggtgtagatttctgggtcaggaaaatcgaatccgggagattaagttgaggaattggttgggtggattacttgggttgatagtatagcccacttatcgatagaacaattcttatgccaataaatctattgttatacccggctggcaagcatcagagcaagactaccaaagcaaatgacaagcgttgccggtgatttttgggtacgtcgtccgtattctccgtatgcatagaaaagctagttaacagcaccaccccgcctaccgacgtcgttgtgccggtgacccggttctacaagtcggtcttgtggtgtgcggcgcactcgatatgcttggtgcacgccaccgccggcttggtgggggtcaggtgacattagtgcgaagggtggaagcatgattcgcgaactactcgccatctctgcgatcgcgagtggcgcggtcaattcggcgccgcgcgcggcggctaatccgcattacgatggcgacgtaccgggcatgagttatgatgcttcgctgagcgctccgtgttttagctgggagcgatatatttttggacgaggccccagcggccaggccgaagcgtgtcatttccctcctcccaaccagttcccgccagcaaacaccggatactgggtgatttcatacccgttatacggagtccagcaagctggagcgccgtgcccgaagacccaagcagcggcacagtcagctgacggtctgcccatgctctgtctgggtggtcaagggtggcaaccgggctggttcaccgacaaagggttttttccgcctgcaggctaacgaccagcctatttttggagatatgcgcaacggttcaccgatcccgagatggctgcgctttgtgctggtgtctgattgatctagtttggcgtggtatgtcggggccatcttcttcgtgtcgatgcttgccgtgttgtccccatgaccgatcgtcacagccacgttgtggggagtcattgggctggcagggttatggtcgagtttacttggaatcgccatggccgttcgggctgaaacaaatattgcaaatcttgcgctacggtgccgagtatgccggaaaaatactggcgcaacctagcaaacccactgatgtcagctccggaccgcgccgaaaaacccaggtctttgccaaagctacagtcgtaccgaagatcttgcagccaaaggagacgcagatgaccttcgatcctaaaaacgcagtcaacgcggccagggacattgcgactaatttcgtcgagaaggcttcggacattgtcgaaaacgttagtgacatcatcaaaggtgacatcgcgggtggcgccaacgatatcgtccagaactctattgacatcgccactcacgcggtcgacaaggcgaaagaaatcttcatcggcaaaggtgaatacgacgaattagagtagctgatagacggcggcagtggcgacattgagttcgtccaccctcatcgtagtctaccgggtactccttaacccaccgcgtgatgactgtggtcgtcttctccaccttggtgaattgtccgatgacctgcctgactggcttgaacgccacgccgacgatttcgttcgtgtatattgtgcgtggtcttaacggccatatcggaaaccatgcactggtagtggaatacacgagcggctgcgggtgttccaggcctcggtccagtcgttgagcagcatccgagtcggtttgtcggtgaaagaacagctgttgacggtgtcgtagctggtggtctttatatatttttatattatgccgtttgctggattagggtgttcgcgggttccccaaccatcagctactgtgagcccgtccacgcgtcttaggtgccctacaggaccaggtccgcagcgatctgttggcggctgtcgataccacacgcagccaacatcgatcttgaagcgatctccttgacgacttgtggctacagcacaatttgagtccacttcaccgcagtgtccaacccgtctcgctgttctaggcgatgatgatgtcgacgtgtttttgagtctacgtggggaagccgcataatgcggctactttgcgactagagtcgtcaatgtgcttgatcatgtcggtggttggggtaccgggcgcgttggcaaccatcgtcatcttcgggtgccgcaacgtcatttttcgacctggggaatggcgatcgcctcggtccagccgagcagctgcaaactgtccttgtcactatctttgactgggacaccatgatctgcgagcattttgcgtgtaaaatccaaatgtccttgcgacatcatcgagcgcagcgttcattcggcgaaaggtgggaatccatgctctcctacttgttcggggtgacgatatcgcgacccagtaggggatggttgcggacgtgctcatcaatccagttgagctcggactttagttgttcgagtgtgaaactgaccgccccaagcatcacgaaaccgtcgaccttgctgacagcgacgacattgtggcagtgggtggaggagcaaattcgaaattcgataccgagtttgtcaccaatggcagtgtgcatgcctgcccctggggcgttggatcgatgctaactgaactgaaacacgttctagttgaatatggagtgtcctgacggggccagtgatttttgttccagtgtgtcaagcgctatggccctagtcatctggggctgcgtcaaatcaccggaggtatgctcaaaccgggtttggtcaggcggactgtagattgcggtatcccggtcaaaccggtggcctggatcctgaccacgaacagcctgaactcctaagcaatctatgataaaggaccctaacggtgggggaaacttcgtcatcgagttgccgttatgtattgggagtgcatgaaactgtccatctgcacatccacgtccggcggagtcattccatagctagtctgcagctccagggtgttacgaacgggctctacggcccatccgtgcgcagccaaccattgcgccgagtcagtctttggctcataggtgagagcggagaagtctacgtcaccagaaatattcacccccggatgggtcgcttccagcgcggcgagttgtttgcggtctaaacgcgaccccaaagcgcctacggcaattcggctgcccggtgcgcacaactcgccgatccgagtgaatagggcgctttgcgcgtcgttggtcaagtagggcaacagcccctcgactgaccaggcgctggatctttgcggatcgaagccggctgctttcaatgctctgggccaatcggcgcgcaggtcggctgctacctcgctcctaccggcgttgggtatagcgccttgctcggctagcacgcgagctttgaattcgaggactttcggtagatcgatttcgaaaaccgttgcaccgtttggccatttgaggcgatatgctcgagagtctaacccggcagcgacgatcaccgcctgtcgtatacctgtgtcaccagcggagctgaagaagtcgtcgaagaaccgagtttgcacgccgtaaaggcgaggaaacgcggtctcattgagggaagttcccgggttggccagcagattcatcaaatacgggtctcgtgaagcggtaatgaaatacttcgcgtattcgtcgcgaaccaatggttgcggccctaccgcgtgcagtgcgcgccagcctgccaccagtagagcggtgtaacccacactgctgacgatgtcccaatggtcgtcgtcggaacgaagtgacccaaattcaggtgtggctgccatcaacccttgaccaccgggacaagtttctagtgtctagcaacctttggccttctctccacgtattcaccaacgcctccaacggtaaggtacggtcacagctccagcaacagggggacggactgttgttgaccaattcgacctgcatgtcggcgccgaacacaccaatttccacctgagcacccagtgcccgtaatgtcgcagcgacagacgaaatcaatggctcagcggcagcacccagagcggctgtgttccatgacggccgacggccctactacagtatcagcgtagagggtgaagtaactcaccaccaggatcggtgcgttaacgtcggcagcggactgttcgtcagcgagaatccgtggattccagagcttatctgccatccgtagtcgccgtgctggcggtcctgacgatcgccatcgtcgctgtgggtgaaatccacgaacgtgaaaaggttttggaggtcgggctggatagctccgaccacctggcaatcgaactacatcgctgctgacgacatgcgttgtaccagaacccacatagtgctcgaatactgccaggccttcctcaagccgagtacagggttactgggtaggtcattaggtctctgtgctggccgtatgatcgaaggtgatatctgggagcaagtcatggggtggtgcagcgtgcggtggaggccgtggctgcttgtgcaccgcagtaatcaaggtcgacccgcgtccggggttgccgagtgttatgccgcaaaaggtggatttcatcgagcgttatctgtcctaagtcgtcggcgatcgacccgcaacatccgatcgacgctataccctgtatgacggcccggaacgcctgctcagttttgccaccgtgcatggtgaacaccattccctgcagcgaactggcctgatgctgtcgaacagcgttgatcatcagccgccccgtgtcttcgagcgggaagctgccgacaccagtgccaaacgccaccagcgcccgcgagcgtcaaacgagctcattggcccttgcgcaaggtcgaaccggtagcccaggtgatgatttcggctgcgggcagacctcctacctcgatcgtcactgtgtgaatcacgtagtgtgtcggcatttcgcgtgctgtggtcttcaccgcttttccgagttcgatcggcgccttccgaatcgactcctgctgcagttacggcctgccggcgcgagcgattgccgtggcaacgccgccaccgtggcgcagctgggattggctgcgttggcgatcgcatcgagcttgctcacgttagcttgccgcaccttactacttgattatcaccacattgtctcgcagaccggcgcccgggatcagcttaagcgggagcgagtgtggattaaacgcatacagccgccaaatcagttgccaccgaggctacgtacttcggcgccacgatcagaaaggatatccatacttcccctaactgaccgaccctcgcactgtcgcacaacggtgatcgctcggcaggaaaaagcgtatcgttaaccacgccgcgcacctcaacttcgcctacatgaataaccatccgcatctcgatgtccagcacaccgatagcgttcacgattttgtttgctcaggcgatcgcggcactggtactagcgaacctcgcaacacatcagttgcctcagtcgccggtggtgttgacttcgtgaccgccgaaccactgcgattcgtgtcgcaccatggatgttgtggttgtccagcaggccgcgccactgatttatcaccgagcagcatggcgcgttcagtgacgccaacgatgtcggtgaacacaatggtgctcagtacgcgttcgacctcgaatccgccccgcacaccagtgatgaactcttcgatctcgtcaagcatcaacgcggtgtcgccacccaagtatatgagggcatcggcgcccggtagcttggacgaagcgggatctagcaatctgcttggccaggtaaagaccgtgcccaacgggaatgcaagtcgaaccgacacgatgacggatcaagatcgggacgctagtgcgcccgagggttttctcgtatgtcaccttctggtcacgatcttaggagacggcgctagccatgctaggtggccccgtacggttgctggccagatctcacccaggcgtggagcgccgtcgtgagcaaaactcggtgcgatggtcgccaacatgtcgaaaccctgttccaacgaatcgggttcgagcgctaccgtcgtgaacggagtagcacgatgcggcctgggcgccgaccgggtagtaaggcgcccccagtgtgtgcagcactgttgacgaccgccaagttgcgcacccactcgtgagcgtcagcgtcgagcacaagttcgttcatcgcagggaaacctcagcgcgaagatcgttgcctgctggcatccaactgcgttcatcacagcgatcgcgttctcggcccaaaacgtcgatcttgacaggttcatcgaaggaagccgcgacgagagaccgactccgcgatggttaactggatctgcctcgctgaacgaggctaggcgtcgatgtaaaatcatacattggcggctcatcgtcgaccgagtcgatcggggcgaacggctccgacatgaccagaaggtcggtcggaccgccaccaaggatctagtaggcggtgtccatgtcgccgcactttgtcatagcgaattctgtcacttcggggcgcattcgccacggccccaggctagttcatgcgtaggctaatggtggtgagcgcacgtgcaggcatcgtggtcactggaacggaaatcctcaccggccgtgtccgagacagaaatggcccttggctcgcagatcggctactcgagctaggcgtcaagctcgcacacattacaatctgtggtgattgccctgctgacatcgaggcgcagctgcgcttcatggcagaggcagg

SEQ ID NO: 26 - DNA (genomic), 40085 bp, MYCOBACTERIUM LEPRAE; double-stranded, circular
  hypothetical: NO
  anti-sense: NO
atgacgtgctggtggcgatgcattcgtcgaatagtggctatgctcgatacacacctaagaggacggtggcgacaaggagatgttcccgttccagacgaatgcgttcgccatgctcaataagttgcggtcgatgcaggacactgtggtgccctgagggatttacggcgcgttgtattgttcccccacgattgaaggtcgcggtcatcaaatttcgtatcgaagtaactgtttcccttgctgggtcagctggttgacatctacaagaaaacgtccgcaagtttacccggcggtgacccggtcgaagaggtcaagcaccgaatccacatcagtacattctactaaagacggtatcagcgtcctggtcggtctcatcgggatgggtagggttctctacagttaggatttcccgctccaggatgggctcgtgcaaccccgggcattacgcggatgcactgtgtagtacttgacgtgttgatggtcaggcaaagatcttgagcggccatctggctcgactaatttcggtatgacaaccgcggaccactacggtgagccgatcccgcaaaattggactgcaattcccgctatgatgttaagtgcgaaagattgtttcggtgaagcagaaatggtcgtctacggcttcttgcttctgagcttcactcagttcgtagactggatccgctgtgctgcaggttcttgcgtgttatccggcattgacaaggtgattagctagccatctagacgtccaattccgcctaatggatgatggatgattgcggagttcggtttgctcacctcgggtgcaatgttggtttcggtcagtaccaggttcagagcgccgaaaccatcgacatcatctgttgcagtggagagaaagtggttatgattgaaaaaatcttcttgagaaaggattgcgctgatcacaccgatatggtcgcgatcgatgtcgagtcgaaatttctggccagtggttcgtcgttcgagtgaccgatcagcggcaccgatatcacggatgtgatctacccctcgggcaccacctaacggaccaaaagcgtgatgatgaaatacttgcagaacctatggccctacgctgatttggtgcgacttcgccgacccttcggtgaagataaccactacactgatcgtcaactcgttcttccgcaccaaggtgtgctatatttctttaatgatcttgggaaacaacgtcattctggtttccgtattctggctgaatcgtatgctggagctgcttgagcgtgaatgagttaccaggcttcctggacggttgacgctctaatcattcgctgctgcttgcctcggtcaattacgacctgtcgtcgttgcgggcagcgatgatcggtcggctgacatcttcatgcaactcatctgacgggtacataacgaattgcttttccagcctatcatgaccggctaggtcctcaccaaagcggcaacggtaacgacgcagggattccttcgaagatatcgcgacaatcgccggtacgccgtgcgatgggctcgaggtacacatcgccgacgatggagaggctttgatccgtgggtgcagagtcatgcagggttatctcgatgactctgtttgccaccgtggaggcgatttatgacgagggttagttgctataccgacgatctggtcagcttggatttgacagtagcggataaggattaacgggagtaagaagggcatgttcatcctagacggcttcaacgcgtacttagcggagatcgagggtgctcgaacacccggagttagcacaagccgcagtaatcggaatcacctacgagcgactaggtcaggtaggtaagaatttggttgtgccgaaaccctccaacctttgtccgaggctgatttggttgtgtggttccgaaagcggatagcgttgtgcaaagctgatatccatcgaatttctcgaagagctgccacttaatgttgccgaaatgtgatggaagacagcttcggtgatcatcggagacatgtacgcgatggtgattgctctgatgatcgcatgcccgatctcactcgggtgtggctgttgctgcagcgcactcgttcgacttgttcgatgctactgccattgacgacatactggacgttttcgtcggttagatcatcgacgggttcgtcgcggcgattccgatgtctggattagttaccgctgtgcccggggtgatgactgcgatcgcatctgtcgatgacgtttcgaccatgaccgtggaggttagctgtatggtggatattttcaccgagcccggtatctgaaagacttggattttctaggatttagatgatgaacacgcagtcttgatcttgcatgagttttttgacgaatatgggttccggcactggatcgatcatccctacgttgtggcacaatagttatctagagtgggagtgggctcctatccccgctgttcgttgttcggttgttcgacatgattcgcatcgaggcggcagagtaagcggatcactcgatgtttatctacctatgtaaccaagcctgtttcagttgtcccatcctgggttgggcaactgaaaaatccgattgctgtcctgcgctggccgggtcaatgcagtcaataggcttggaagatctagtttaggcacgatgacttcgacgaaaaccatctgatccttaagctcggcggcgacggcgaaggcctcgtcgagctcaccgtaggtttctgcacggaaggacgaatgattggctacccccagcgcaccggggatgtcggtccaacgccatctggcaatgttattgtagggagctgttgctccatgtatcgcccgttcgattgtatagccgtcgttgttgactaccacaatgaccggtgacaacccctcgcggtagaaggagccgagctcctggatcgtcagttgcgcggcgccgtcgccgagcagcaacaccgtcctgcggttgcgatgcgctaaccccgcaccgagtgctgcaggcagcgtgtaaccgattgaaccccaaaggggttgaccgatgaaagtcactcctcgcggcaaccggtgttccaccatgccatagaacgcggttccctgatcggctagtaccacgtttcccggtgtgagcgctgcacagagcctgtcccacaagatctgttgggtcagccgttgagtgggtgatggtgtgtccgcagttgggttgccaggaggtaattccactggtggcgagctgacaccgcggcgcaccaggattgacgctaatgcctcaagcgcgtcacccatttccagtggagtgaagaccttatcggccacactgctctggtactgcccgacgtcgatggtccgggctgggtcgatccgctggctgaagaaaccactgaccatgtcggtaaaaaccaccccggcggtcaccagcacaggtgcctgctcaatcgccgcgcggaccgcttcggtgctagcagccccggcatagatccccaggaagttaggtgagctctcgtcgagcagacttttgccccacattaacgtggcgtacggcaccacgtcggccgtcagcaacgtctcgagctctttgaccacttgcaaccgatggaccagcaagtccgccagcaccgtcatccgcttatcggcaatgagtttggtggcggcatcgatgaacagcgacagcgcacgcgggctggtgccgtcggtatggcccggcaatggggcggcgggtggttcggtagggaagcgagctacgtcggtggacagtagtatgtatccgggacgtttgtgcttccgcacttcgctgagtacccgatcaatctccttgcatgctgtagctgttgtgagattagcttgggagcaagttatttcgctgctaatccggatgaagtgctcgaagtccccatcgcctagcgagtggtgtagcgctcggtgggtgctttgcgcgtctttagggggggcgccgacaatgtgaacgacgggcacatgctcagcgtagctacccgctatcgcgttggctgccgagagttcgccaactccgaatgtcgtcactaaagcggatattccgcgtaaacgtccatacccatctgcagcgtatccggcgttcagttcgtttgcgttgcccacccatctgatggtcggatgggcaacgatatggtcgagaaattccagggtgtaatcgccgggtacgccgaagatctctgtgacaccgagttcagcgaggcggtcaagcaggtaggcgccgacggtatagacggcttcaatcttgggggcggtcacgaagacgacggtacgctttggtaggaactactccaggccgggctccggttcgctatcgtgcgggccacggcaatcaacggatcccgcgacgtcgtaatcgaagtcaagttctgcagaggttctcgacgtcatcgtcgctatcgaaacgatacccaagtggtcagctgcgtatcagggcgcctgggtgcccgagacgggcagaccagcaaagttaagatgtaaagtcaaggccgtgggcgtcaccgactaacaggtggtgccatacacctgaagtgacaacggtgatgagctggacgctggtcaactcttcggtgcagcatttgcaaaatgcgaattaattaagaattaattaagttgtctctcaagggtgatagcactgtggtcaagttcgagaatcagtgtcaacccggtggtaccattgtctgtctggttttgtgctcaaaagcgtggtaaacgagtcgatcgaagcggtgtgcaggttgagtgctgcaggtgatgagaggtcaaatagtcaccgtgaactttggtagtcccctggccggggccaaggtaatcgaactcactggcatcggaccggggtcgcatgcagggatggtgctggctgacctcggcgctaacgtggtgcgggtgcgccgtcccggcggactgacgatgccgtccgaagatcgcgatctgctgcaccgtggaaagcggattgtcgacctggacgtcaatacgccgtcgggcgctattgcgctattggagctggcagccaaggctgatgtattgccggattgtttccggcctgcacctgcgagcgatttggtatcggtcccggcgagtgcgcggcgattaacctccgactgatcttcgcggcgtattacaggttggggacaatacggaccgttggtatcgacggcgggtcacggacatcaactacctcgcgccgaccggtgcgcttttggcgctgagataccgcgatcggccaccgatgctgccgctgaacctggtcgtcgacttcgactgcggctcgatgctggtgttgctgggtatcgtggtagcgttatatttaaactctaattaatgagattaatcagcatgttccggtagggagggggtaagtcgtcgacgccgctatggtcgacggggtcagcgtttttccccagatgatgtgggccatgaagttgacctgcgttctgcgtgacgggcgcgagtaatttctgctttacggcagtgccccgttttctagttgctatgagatcgccggttgtagatattatggccgtcggcgccatcgagtctgcttgacatacgcttcgtatcaacagatgagcgagatctttgcgcagcggttcgcccagtcagaccagaacccaagaccagggaccactggttttctctggtcccgatgcttgcgtcacaccgatgttgacgtgaagtgaagccgcgagcaacgaccatctgagagcccggtcgacggtgatcatctctcatggtttgaccaggctgtgccggctccgcggtttgcccgccgactggcaccgtgacactgattgtcgtaattggttggtaacagaatcgttgcccattcgccctgtgcgggcaggaccctgttgctcgcctagaagttagtggcttttacaagcgccgcgggaaatcatcatttatgtttacctggaagggattctaaaggcgttagctgatatcgggtcagtgcccgttttggtcgttggtgtacaagaatgctgaagtcatcgacacctaaatcccggtgggtggctgcatcatgtcaaggttgcggtcgaagtggtcgggattgccgaatcggacactggccgaattctactgggtggtgtgggatgcctacaagactttaaaataccagcgtggccagcgcgtcgcgtacaccctgcgataggtgggtggggacaagatgtgggtgtgtttcgccatcaccatagagccgtcagcgccgctgccggagtttctgcttaagcgaggtcttgagtttaaagtatttaaagccgcaacggaagtcctgtggaacttcgtcatgagtgcggacggatctataagtagtgtatccgttcttaagcacggagagtcgcctgattgcctaatcgagagtgtcgtcgcgtttgcagaagataaagtgcaccaggtgattccacacgtcggcttgttttgaggtgtgctcggctgccggatcgcagaatgccgacatttgagatggcgtccattccagccttttccagcagggccgagcagaacgccgcgctgtcgtcgtaacctagcggacgcgggtcggcgcagaggaagtacgtgccgtagctgttgtacaatttgaagccaatctcggtcggcaccgacgacagccgatcgtgtctgtcttgcaacgaactccgaggcctggtcacctaggcgtcttcggtgtccaacgccaaggttaccgctggctgaaacggcgcgccgccgacgtagctcaggtactgttttgccgatagctccccggcgatgagatctgttgttccgcaggccacccgatcttccagccggtgcagttgaacatcttagccgcgctggaaatggtgattgtgctttcgaccatgccgtcaaagccaaccagctgcaagtgttttcgtttttcgaacaccaggtgctcataaacttcatcggtaatgaccaacaggtctgccgccacggctagctccgctatctcggctaattcggtcgcgctcagcaccgcgccggtgggggttgtatggtgagtttacaatcaacgtgcgggtccgaggtgtcagcgcctgtcgaaatgcgtcggcatccagcgcaaagccgcagccaccgggtaccatgtggtatggctacccgattagcggcagccatcgctaccgctgtcgtagaacggctcgagtagaattactttagcgatccgggttcgatcaggccgatcaccgcccctccgatagcctcggtggctccaaccgttgtaagaaccttaggtgtctgggatcgtactcgacgccaaaatgctgctggcattgcgcggtgatggcctgccgcagcccagcgatgcctatccccggtgggtatttaattgacttcgtcggtgatggcgtcttacgcggccctcagcatcgctggcggtccgtcctcgttgggaagtcgtgcccgaggttcactgcgccgatgcgtgcagctagagctgacatttcagcgaacaccgtggttgcttaggggcgtagtcgcgtcactgttatggcaattgagctttatggagtgtcgctgccagcacgaccgtagtgccacgttcggtcgctgaccagcgcaaccttgcccaaccaacaggttggccgaaccctactgttagtgtgcctgtactgtactagttcctagtctttaagacggaatctaaccgcccacatcaatagtaaattaaatttttttgcgaacaggaagccgacatgtccgaagaagctttcatctatgaggccatccgcacccctcgcggtaagcagaagaacggatcgttgcacgaggtcaagccggtaagcctggtcgttgggctagtcgaggaattgcgtaagcgaaaccccgatctcgatgagaacctgatcagcgacgtcatcttgggatgcgtctcaccggtgggcgatcagggcggtgacattgcccgcgccacggtgctggccgctggcctgcctgtcaccgcaggcggggtgcagctcaaccggttctgcgcatcggggcttgaagccgttaacaccgccgcgcagaaggtgcgctctggctgggatgacctggttctggctggcggtgtggagtcgatgagccgggtgccgatgggatccgatggcggcgcgatgggcttggacccggcgactaactacgacgtcatgttcgtcccgcagggcattggtgccgacctgatcgccaccatcgagggcttctcgcgtgatgacgtcgacgtctatgcgttgcgcagccaggagaaggccgcggccgcgtggtcgggcggctacttcgccaagtcggtggttccggtgcgcgaccagaatggtctgttgatcctcgatcacgacgagcacatgcggcccgacacctccaaggagggcctggccaagctgaagcccgccttcgagggtcttgccgcgatgggtggtttcgacgacgtggccctgcagaaatatcactgggtggagaagatcaaccacgttcacaccggaggtaacagctccggcatcgtcgacggcgcggcactggtgatgattggcagcgaagctgttggcaagtcccagggcctgactccgcgggcgcgcatggtagccaccgctaccagtggggccgacccggtcatcatgctgaccggccccacccccgccacccgcaaggtgctcgaccgcgccgggttgactgttgatgacatcgacctgttcgagttaaacgaggcgtttgcgtcggtggttctgaaattccagaaagacctgaacattccggacgagaagctcaacgtcaacggcggtgctatcgcgatgggtcacccgctgggtgccaccggcgcgatgatcctcgggaccatggtcgacgaactggagcgctgcaacgcgcggcgtgcgctcgtcacgctatgtatcggcgccggcatgggtgttgccaccatcatcgagagggtttaatagcatggcagacactgcaattcagtggagtaaggacgccgacggtattgtcacgctgacaatgaacgacccgtccaggtcggccaacgttatgaacgagatttacatcgaatcgatgggcaatgcggtggatcgcattgttgcggaaaaagattcgattaccggtgtggttataaccagcgctaaaaggactttctttgccggcggtgacctcaccgcgatgatcaatactggatcagaagaggccgggcaatgcttcgacactgtcgagacggtcaagaaacaattgcgcaccctggaaacgctgggcaagccggtcgttgccgccatcaacggtgccgcgctgggcggcggtctggagatcgcgctcgcatgtcatcaccggatcgctgccgacgtcaagggcagtcagctcggcttgcctgaagtgacgctggggctgttgcccggcggcggtggggtgacccgcacggtgcggatgtttggcatccagaacgcgttcgtcaacattctgtcacagggcacccgctttaagcctgccaaggctaaggagatcgggctggtcgacgagctgttgtcaacagtcgaggagctggtgcccgcggctaaggcgtggatcaaggccaacccggaagcgcacgagcagccgtgggacaagaagagctacgagatgcccggtggtactccgacctcgccagggttggcggccattctgccgtcattcccgtcgctgttacgcaagcagctcaagggcgcgccgatgccggccccgagggccatcttggccgccgcggtcgagggcgcgcaggtcgacttcgacaccgccagccgtattgagagccgctacttcgtttcgctggtcaccggccaggtcgccaagaacatgatccaagcgtttttcttagatctgcagcacatcaattccggtgggtctcgacccgacggcattggtaaaaccccgatcaagaagatcggtgtgctgggtgcgggtatgatgggcgccggtatagcctacgtctcggccaaggcgggctacaacgtggtgcttaaggatgtgagtcttgaggccgcgcagaagggcaagagctactcggagaagctggaagccaaggcgctagagcggggccgcactacgcaggagaagagcgacgttctgctggcgtgcatcgccccgacaggcgaccctactgatctcaagggcgttgacttcgtgatcgaagccgtcttcgagaaccaggaactcaagcacaaggtgttccaggagatcgaagacatcgtcgaccccaatgcggtactcgggtcgaacacctcgacgttgccgattaccggtctggcgaccggcgtcaagcggcaggaggactttatcgggatccacttcttctctccggtcgacaagatgccgctggtcgaaatcatcaagggcgagaagacctcggacgaggcactggcccgggtgttcgactacgccctggctattggcaagaccccgattgtggtcaacgacagccgcggcttcttcacttcgcgggtgatcggcacttttgtcaacgaggcgctggcgatgctcggtgagggggtggaaccatccagcattgaacaggcaggtgcgcaggctggctacccggcgccgccgctgcagttgtccgacgagctgaatctggagctcatgcacaagatcgcgatcgctacccgcaagggtgtcgaggatgccggcggcatgtatgagtcgcacccggcagaaaccgtggtggagaagatgattaagctcggccggtccgggcgcttgaagggtgccggcttttacgagtacgttgacggcaagcggtccgggttgtggctcggtctgcgggagacgttcaagtcgggctcgtcgcagccgccgttgcaggacatgatcgaccggatgctgttcgccgaggcgctggaaactcagaagtgcctcgatgagaacgtgctgacgtccactgccgacgccaatatcgggtccatcatgggtatcggtttcccgccgtggaccggtggcagcgcgcagtttatcgccggctactctggcccggccggtaccggccagcaggccttcgtgtcccgagcccgtgagctggtggccaagtacggcgatcgctttctgccgccggagtcgctgctatagtcgttttggtttttggtcgcgttcggccggtcctagcgtcgaaacataacctgggggctgcgcacgggaacaactatctgccgttcgtagatgttccgtttgcctgttagcacgtaagcgctgagtatcgaaagactggtgttgccatccaccgcgggccccgggcagtgtagtaggcgtcactggctagcacgattcgtccgcgcggccagctggctagctgccaatgagtgatcgagtagaaatagaatgctgtgggtgcccgttcgggcttgctaagccagttgttcatctgcgtatgtatcttggtcaaccccgcgcgcagcaactcctgctgacgcaaggaatctcggtagtgatacttgagttcgttttcggtgcggaacaggaacattgcgtgcatcgtcgaggggttgcgcagtgtagatcgccgctagacggccagcgtcgatgtgactgatcacatctggtcttcgtgtgcaaagctttttcggcaacgactccaccacccggtacccaccaaggaattgggtatgcccggaatcctcaccgaaaacaggggacgaacgtttgagtgcagcccgccggggttcctaccacgaagtcggacttgcgtggcgtcgcgcgctcgaaggtcacctcgctgtcgggggtgcgtggccgtgatcagagttaccgaactaggtactcgatgtggtcgcagccgacgtcgtagtacgcctcgctaagattgtcacgcacgattgcacacgtgcctgtcggatacaggctgcctacagccttggtggatatctatgcggaccagtcggcgcgtggccctcgcggccaaattcgtctcggcgttcgttctggtggccagcgcctcgatccgcggcagcacgcccaacttcgctgaattctccgacaagctcctcacctacttaacgtttggtaagcttaaccacccgtgcttacctatcggtaagtcagttacgcttgttgtagtgaatagcctccgtcaggcacccgacggcacatccaagagagtcgttcgggacctgtttcttcagcagggtgcagcagcgtgccagcctgcacgacgtcgccggacaagttggggatcatcaaacccgcgctgtactgtcatctatgtctcgtgagaagccctgttgcgcagcatcttggttccgctgatcgacgggggcgagcaattcgttaccaaccaggaaaaacttggctaaaccggttcccgcgagttgcttcagttatatgccagtttacactaccggcaccatggaggatttcgtactggtgtgggccgaactgacggccctgggccgagcttggcctcatggacaaggcgttggcgtggcgttaccggctcggcaaggctggtattcggttcgaatccgacgacagcagaggcccaggactcagcgctaagtccacccgcgcgggtggacttagcgcaaccctttatcaaagcgttgcgagtgtcctcggtagacgttgcgcgcgtcgcgctgggaaaatgcgactaagccgggtggcggcatgaagtgagtcatcatcctagtttgtagatattttaggaatcgttctggcacaataattcttgtgcgagcgtgcatcacgttgcagctctgcttctaggaagctagaccgagtagtacggccgttgcagcagtcgtagcaccaggtgaataatacctgcattaaacagattttttgttggcgattttcagctgaaatagtttcactcctattgctggttatggtcatccatcgtatttatggtagcgctgtcagaaactaggttaggtccttgttatcgatttgcggtacgcgggttcggcctggttgtctgccttgcgaaacggtctctgtgtgggcgccatatgtggcaggctaacaacaccaccaccaccaccactcgttcactcccttgactatcaacaacgtatcctcggcatcagccagcgcttcaaccaaacccggagcgtcgatggtgactgcggactagaactctacactgaatcctttgtgaggagcggctaagaaacactcccgatggtggcgaacgctatgctgttacaccgctgctatcagtaagtcgttggtagcacgttggcgatgtagcaaatttgttgcaagtagaagctgtcttcttcactgtgggtcggatcatttggcggccagtgtttttcgtggatttctctggtgcggatcagcaactggtggcggccagcgacattgatgagtcgcacgagataagcaatgctgttgtcagtgtgaaggttgagtgcgattgcgggattgcggactagtacaccagcaccgaacgttccatggactaggtccggcaaggtcgatctggcacagtcggtattcgggtggggaagtttacggcccggcttgtcaccttcggtggtgacccagaccatgaacggtaaccatgaaggctggtgcgccggctggatacggggctgatgagcggcgatctgtttggacaccgatcccgctatgccgtggccataggcttggttggtgctatttagggaaggctgtgagcactactacacattgataataattacattttatgcaatttgcaacatttactgatcttaacttggcgttgcgctcctcggggtcgtgtaataatttctgcgcataacgcgagaatgtatgtggaaagaaggtatttgatcagcacggttgggtcagagtgcctttcaggaaaatctgagctgtcgatgaagctcgataaattcttcaaagataatgcgaagcctcgctgaggtagcgctgtttaaagttgtagccgcgacggtagtcaccaaacagaccggatatcgatcatcacggcctacatgtcgcagcagtacgccggggtcaaaaacgacctgaccgtacagcatcatcgcgctatcgacgaattctttcgtttcccaacgtcttacctgatcgactttgacatcgatccatgcatcgatgtcaataccaacctcgtataagtgctacgtgatagtggggtatgtgacctggcaatgtgttcctccggcttaactccctagtaccgcaacagcttggcagcaatggttgatcatgtgcaccagcttgagcaacttcctccggtcgtaccttcccaggtaagctacttcggtggcaatgtgtaatgtcgatctattcgttctagcacgtacgttgtcgatccctgggcgctggaacagcggagaaactctcctgttaaagaggtcttcctatccagctaatacccaccgatatcttgacagccactgaaaagcagtgtgggttatggttatccagcgttgaagacctgctcttttaccaagtcgggacgtcggactaccacatcgatcaaatcgtgtgtcacgaaatcggacacatggtattgggacactccggcggtcgacaagtcgatatcgaaagcacaccgaacgtcgagatgtttcgcaaactgctacctgaaatctatcccactacagtgcaaagcgtgttggggagtaaatttttgttgacgatcaagagcgtggcgctgaagtgttcgcgaatgtgctggtgatcgccgcagtcgaagccggcgagcaaacttcgatgatgtgcaacgtcttcttccaatgcgcttgactcaggaaatccattgatgagttcgacagtgtcaggtgtgattgcctggccgttgatcatgtttacgatgaccattgtcgtcacgcgctgtcgatggttaaacaacaacctgtatggcatatacctcaacaaccttatggcatttacgctattggatcagttgctgcatgagcacctcgtgcataacacactgtccatggtccgctgatacctagcaacatatatggcgttgtgttggcttggctatcactgaatttattggtttcatcttgctgtggacgggattgtcgccggtcaaaacgcgtcgaggcaacgatcgcctggccgtgctgtttctgtgcgcggcatatctcatctgtggcacccacgctccggccttcgtcaagtttcttgaagccgccggaggctgggattgtgtagtcgcccgggccttctgcatgaccctgatcgtggtcttaggtttttgaacctactctggaagtctctgcttgagccgcgtaatgtcacccagcgcagcgaacgcctcatcaccatcaacacactgctactgggtgtactgcttgcactgaccgttctgcaagaggttttcctgcagatttccgaccaacttggctgtactgataccgctgactacaggttgcgggtccgcaggtctatgaatttctggacggtgttcggcaccgcatggtcagtgttgtgccgtgcatgatgaagttacttggcggcccgggactagatcggatcagccgcagctggcgtaagttgtagccgttgcggcagagtatggtaactgcggtcctacaatgtgcactctacttcgacatcgatgaccgtcgacaccttaaaaccacgctgcaacgataccaaaccgtagtagaaattcgtgacgccatcttggccgctcctttttgcagtgaaatagcccgggccgatctagtcaggttcctctaacgctgcaccggcttgggaacatgacgccgcaatcgagattctgcatctgggcttaggccgtcagagacaaagccgctggcgccacgcctgagccaggcccacgtaatgctgagcgggcaacaactctgggaggggtaagcaacccaaactattgaagctggcgaaatggtggtcggccgtctacgctgccactggacacatcgacactatccggactcgatacgatgaaggtaagttcgtcagtatgggcctggttatcctcatgtcgattccatgtcagcgtttgcagttgtttattgttggtgatatgatcactattcgctttgccaaactgcctaaggactgaccgttcagttcggcaaggcttggcagcggaatcgtcgagcaacgcatctcagtcctgtcgatcatcgcgctggctgaccccattgttattgactagatcaatgacgaaaccgtgtgggaaaacatattgggctcgttatgcgcaaactgcgcctccttatgggtgacgagctgttcacccgcttataacaaggaatccaactggggcaaggctcacaacaattctattgcccgcctttaccaaaacagctatggtgatttaccaccgcaccatggctactgcggtgcgtgaattcatcgagttctgggctaccgacgatagcgccgaccgattctagatcgacatccctgcccaagctaaccggctccccaccgaaatcattaccagtaccggactgggctactcctgcagcaaactcaggaggagcccagcagcaacgcatttgttacgtgtaagcagctacttcagacttacctcccgcatcaatgccatactgttttataacaaactcttcgggcaaaataccaataacagcatgtcacacgacaatgcctacatccgccgacgaatacctcttctcgtatttaggttggcggctgtcgtcacccgacagcaagtcagcacgacgacattctcgacatcatgttgtacagtgccgatcccagcaccggcgagcaactcgacactgataatgttgttaaccagatcctcacgctgttagtcagcggcagccaaacattggccaacgccatcgcgttcgccttgcactatctcctctccatccaccacgacatcgccgcccaaacccgccgcgaaatctaccaaaaccggtcagatcgtggtatcgccaacgtatcgtattgttcggcgatgtcgttaaactgcgatgcttacgtcgtgtcgtcgacgcaactttgcggctgtggtctggtggtgccctgctacttgcgccaggctcgccgtgacaccactctcggaaacggcacatctcttttccacaaaggccaatgggtgatcgtcctgttaaccgcgccgatgcctgggggcccgatgctaacgaattcaaccccgaccgagtcttgccggaaatttgcaggaagctgccccgtatacctataaatcctctttgggaccgggctccgcacctgcatcggtcgccgattcgccctccacgaaatggcgttggagttgacgatgatcgtgcatcaatacatactatctagagccgacccgggtactgcctatcgatctccgaggcgttcacacttaaaaccgtcggtctgcacggctacacagccttctctaaaccaaaattgctgctgactgcatacaacgaaactacctttgaacttcagctttctggctaagtggtgcccgcgttgagctaaatattggtcgtgatgtacctcgttttgaccggaggtgcggccagtaatgaaggcaacttcgcccgaccttcgttggcacgaaatctgtgctatgcttagcattgctcaactgtgtcccagaattcgtagatgatccggtgcgtttcgttgtattgattgacgagcatgtcagtgctgaggttcccgtcgaaagcttgggtgtccccatagcacccagcctatgacgtcgctggtggcttgcaccccttcacagcttgaatttcagttctaatagcactgtaatttacatggttatctctatgagttgcaactgcgatttcaaggtagctgtcgttgtgcggttgcttcatcagtctcgcatgccacatgggtattgcgcggagggcatcacacagaactaggaaagtgatatccataatttgtgggggtgacctattagtcggtgcggtgcggtgcgccgggacggcagccggagcatgcgggttacggcaataagaattcaacttccgttttttttgtgtaacgctgttgtacttctcagtgagcgtgttttcttctgtagaagacgcttgtccccgagatctctacctggtatgccgaaaatcggcagttgatcgacggtcaatacggtgactgtggtgccaccacctttcttgcacagccgaggtggctgtggcggacagattagcgagttgttgttgctgcgccggtgggactgtggtggcgtggaccatccagggtttcctgatcggatcgccgttatgccggcccgactggcacgcatttcgtgccagtcggcataggcctggtcccgctgggcgacgtgaccccggtcgaggatcggctgatcgagaacgacccggtcaagttgcagttcgccaggaggtcgagcccaccatggtgtcgctcaccaatgacgaaggcagcaaagaaatcctcacgtacgtgttagctccggtcggagctggagatgactaatgatgtagctaccgttggggtgggtctgcatccttttgggaggttcgataagacgcgatgcagatgggttacgtccaatccacgctgacggacgcggggtgacgagcgtgcgccacagcagccagcgccattcaacaggacgttgacactattcggttgggcaagtacgacatcggcgtcattgtaggcctggaaacgtacctcgcggagccttcgctgacgatcccgctaagttgggctgccgcagtggtacgtgcagaaaggacagttcgtcaccaccaagttcttcggcatgaaggccaacaagtcacaacatttcccaagccacgctggctaaagtcgctgctaagaactactgcaacggcgcactgaatacgaatgtgttccgtcgcaagccgattcttaaggacgagatccttaacgcaatgcatgttctgtgcgctcaataagggtgccttcgccgtgatcgtgtgccttggcgatatcgcgcacaagttcaccgacaaaacggtgcatgtgcatgttaccgagatccgcacccggcgttatggcgcctacgaggtgcatgccacttttgccccgttagtcgaagacgcttcgcctaagaggtgtacgattgctaaggctgtctaccggggacggcaggcatcggacctgaggacatcgacttcgcccagttgcaggacatcagtgccggcgcccgaggtcattcaaatggacgagacggtcctgtgcgccgacggcgagcaagaaaaactagcgagctggtagcgtcaagctgcgaggcaaggcgggcgagcgtcaggtgtccggcaattcgcgtgttggtctggtccaagtgtacggcatgcatgaaatctcgttagcgatcactctgtcaggctagatcgccgggcccagcaggtcgtcggcgtcgcggatgatgtagctgtagccttgctcggctaagaatcgctgccggtgtgcggcgtattcggcgtccaggctgtcgcgggcaaccacggagtagaagatcgctccaccgccgtcggccttaggtcgcagcaaccggcccagccgctgcgcttcctcttgacgtgagccaaaagttcccgaaacttgtaccgcaacagcggcttccggcaaatctatggagaagttggcaaccttggagaccaccagtgtgaagacttcaccgcggcggaaagcgtcgaatagcgcttcgcgttctttggttctcgttgatccttgaatgattggagcgttgagctcggaaccaagttcgttgagctgatccaggtaggcaccgatcacgagggtttgctcgccggggtgtcggctcagcaccgacttaaccactgcaatcttcgaatgcgctgtcgagcagacacggtagcgttcttcgggttcggctgtggcgtaggtcatcctttcgttattcgtcaacgtgacccggacttcgacgcactttgctggcgcgatccagccttgttcctcaaggtccttccacggcgtgtcatagcgtttcgggccgatcagggaaaacacgtcaccttcgcggccgtcttcgcggatcaacgtggcggtcaggcccagccgccgcttggactgcaggtcagcggtcatccggaacaccggtgcgggcaacagatgcacctcgtcgtagatgatcaggccccagtcgcggctattgaagagttccagatgacgatactctcctttggtgcggtgggtgatcatctggtaggtcgagatggtcaccggtcggatttccttgcgctctccggagtattcgccgatctcgtcctcggtcagcgaggtgtgcgtgatcaactcgcgtttccactgtcgggcaaccacgatgttggtgactaaaatgagcgtcgtcgcaccggttttcgccatcgcggccgcccccactagcgttttgccagcgccacatggcagcactaccaccccggagccgccagaccagaatgaatcggctgctagccgctggtaatcgcgcagctgccaaccgtcctgatgcaggataatcgggtgcgcctcaccatccacgtaaccagcgagatcctctgcgggccaaccgatcttaagcaaaagctgtttgatccggccacgttcgctgggatggacgacgactgtgtcgtcgtcgatgcggccgccaccatcggtgcgatcttcttgttatgtaacacctcctccagtaccgtgcgatccaggcttaccagcgtcaggccgtgggcgggattcttgaccagttgcagccgcccatagcgggccatggtgtcgacgatgtcgaccagcagaggctgtggcactgcgtagcgcgcatgactgatcaacgtgtcgacgacttgttcggcgtcatgacctgcggcgcgggcgttccacaacgctagtggtgtgatgcggtaggtgtgtacgtgttcgggtgcgcgttccagctcggcgaacggtgctatggctgcacgtgccgcatcggctagcttatggttcacttcgagcagcaccgttttatcggactgcactatcaacggcccgtcggtcattagtgctgctccttctcgtcgtttcgtgagagtccattattggctgtcggacgacaccactgacgtgatgcggtggatgacaaagtcacgtagccgcccggtacccggatcgaaggccaccagctgaccaccccgtatggcaataggcgataccatccgttgggtggcaatgccggcagcgtcgagatagccgatcaccagcgtggtcttttctttcgtggcgcgttgcaacagcgacatggtgacggtcgggtcgacgcgtataccgccaaacggtgtggcggccactttacgtagtaccgcgatgaccgcgttgagggtctcaaggttggggcgctgcagtgggcggtatggccgccgatgctgtggggtgggcaatctcgctctgcgaggccggacgtcgacgatggaaccggaggagtcttcggctgctggggcgaaccctgcggactgcaacgtgacgaggacttcggcgatgggggcgggagacaccgccaccgtcggagctagggcccgtagctgcagttcctctgcggccgccactgtctgggtcagtagtgccgggtcttcgcaccggacgaacgatgcggccatgccgatccggagctggccatgtcggcgcgcaacatcattgatgagatatgtgagcctttgtggaaccggggttttggaatgattcgtgaagagtgcatgcatccaatcgcgagtcttgccgatgtcgagtgcatgccggatcgactgctcgctgatgcggtacaccatcgccgtgccggctgattcgacggtggccactgtgcccagttccttggcaagattgcgttgcaacggcccgggtaccacgaccgtcaggtcggcttgcacgagaaagtggtcgatcggttcgggcagtgccgcgtcatcgcggcgaccgcgatggctgggtcggcggaggcaatggcctcgtccaacagtgcgcgtccaggcgtgctgattgcaccgcgacccaccagtcccatagtgtggccctcggctaacatatcggcgaccggtccgggctgcagccgcctggcccagcgtgggcgccgccagatcagcgccgccgacgcctcggctgcttcgacaccgactccggctggtagttcggcgagcatgccgagcaaaagcctgcgatccagcggtgccgccgtagagtataacgaatttgacagggcgccataagacttggcgtctggtccgcggctgccgatcaacgcgggccggcactgcaagtcaagccaggtgctggccagcaggtgccaacgctccgcgggaggcattgcggtgaaccggtcagtggccaccgtcggcgcccaataagggctgtcaccagtggctggctctggatcgggtatgccgctggctattaatccagccgcggccgtgacctcgaggagcaagcccagtcgcggctcgttgatgccggtagctttggctagccgcttgaattcacgaactcccaatccgccgttgcgtagttcgtaaaccggtgcgctgccgagggtctcgagcagtacgtcgagttcgtgcagtgcctcgatgactgccccggctgcttcggcgtcggcgtcgttgggtgtggttaccgaaaccaccggatacggctgcgtcagctgcgttggaccggattgctcgccgcgtagcacctgcccgacgcggcggggcagaatcaccgtatcggcatcgatgcgtcgtagcagacccatcgcgagcagctgtggcaccggccgatcgggtggagctccgggcgcggcgtcgcgggtgcgccccagtggggacccttcgagcaatttctgcagcacgtcccgttgggtttgactgaggcgagcgatcagctcggcgatttgttcgccggtgctcgagatgtcctcgagtgtgacttgccccggatgccacggcaacgccgcggcgcggcagcagctatccggactgtggtctcaccccaggccagggcgcgttgccgaaggttatctagtgcgctgaccacgtcggcctggggagcgcggtcgccgatcagcgcctttagcttggtggtcggtaccggcgtgctatcggcctgcagtaccagcagtgcatcgatcaccgcgaattgcaagaagttgagttcgtcggtggcagctttgattgattgacgggcctgtgccgccgcagctagcgccgcgatactgccaggtggcggttgggccaggtcgggtcgcagctccagtagctggatcagccgctcgtcggacaagtcggccagccaggatcccagcgggatatccggggtgttgtcggtcattgctgaccagcgtaaagccagcgaggtgtgacgcaatgctgagtgactcagcgggtgagcaagacctgcagcgcggtgcttcgcgtcacatgcgagtatgaaatctgtaaactactatgtcgtggctgacattgctaagagcaaggcgcataaaagcagatacgtagacaacggctggccgacgactgatccagaccaccacgctgtaagcgaattggtgaccgattgcgccggtgcgttatcgccattcggcgacctggtgtttccggtgcccgctgacgacctgccctacgtgcacccggttactgttgttaaccggtagggccgtcgagatggctagggccgctgaagcgcctaggtctgctgcgacatgcgggtcgggaggaatcccgctcggttctgttgtctcaatacttgaaaaagcgaggggcggtgcaacatggggtcggggacgttaccgagaagatcgccacaggcttactgctgttgacgcgggagccttgcacacccaggtgcacgtggtggccgttgatctcgaccggcagcctggctcatcaaaaggtgatgcgctggctaccgagtgggtggcgggtattctggcggtcaaacccaccagtgacctgatcccgctatgccaccagttcgccctcaccggtgttggtgtggatttcaccgtcgtcgactacggatatcgagatcaccctggacgatgtatagcaccgaccgtgcaggcgtgactatggaggagttgactgccgtcagtatggcaggactaacactctacgacatggctaaagcggttgatccggcctgcatttatagcattatggatgctccgcaaggagagcggcaaacgcggaacttgggcacggtgatgtgcggctgatccgcctgcattattcgtactcaatactcgggcgtcggccggtgggtatgacggccaattcgggctaatcatcgtcgaatgccttggagagcatggcttttcgccagtgcaaccgtagatggttgccgatgggaactcggttggtgaggcactgcgcgacgcggtcgacgcgtgtgtcgacgtgatcatcacctcgggtggtaacgatatttcgcctagtgtatagtaccccggaccagactatggttgtgctggtggattacatgaggatgacatcatccgccgcagcgggttgtcgaaggtaccgacgtaggtgctatcgcccggcgggtgcgtgacgaccttgccatatgtgccgatgtgctggaccacgtgctcgatcaattcgccggcggagatcgccaatgatgatgctggtgctgcccgccgctataaacgatcagccgatctcactggccgagcatgagtatctagttgaatcatcagctggtcggatccatcgtcgttttcgttggaatgatccgctactatgacggcagacgtcgggtgttgcgggtcgcctatttcgcacatccgccggtcgcccaggtgttcattgatgtgttggttgagcagtccaacagggtgcgtgcggtcgcggctcgctatcgacaggggcattcccctaatctggttggccccataataatatttaggggggcggctaccggtgtggaagcatcagttcgtcgatggacggtgccgggcgagtgcgtgggctcggcctagtgttagctgaggatggccggctgggccagtgcggccagcgcgccgtttctgtgcacgtcttccggcccggatcgcttgccacagttgctgtatgtagccgatgctcgaggtctgctaaggtcgcgccaggggtgagggtacgtcgcccggtgtcggcgggaagttgtcggccggcggctggggcggagcgggctctgcaggtggcggtggggctagcggtgctggcgcaccgttgatccagggcgcgcccatccctgcaggaagaacttcctgcagggatgggcccgataatccgtgaccgcaggcaggccaggcgccgctaccctgggtcgccagcacgcgctcagcgacggcaatttgctgttctctggtagccagttgagccgatggtgcgtactcgccaccaccatgcgacgcccaggtaccttgcgagaattgcaggccaccgaggtatccgttgccggtgttgattgaccagttcccaccggactcgcaacgggctacctgatcccattcgctgtcggtggccgggctcgcctgtccggccagagcgatactgccgtctagcatcgccccggtaaaggtgattttagcgacgatgatgctcgatgtagtgagtttacggtaactttcactcatacgccaggtattcctctcgatacgcgcttgcgaagtcagctgtcggattcgggttggagaggctgccccgccgacgtcgtaatcatcaggaaaacggcgtcgacttgaccccaaggccgcgcacggccccggcccgatcgttggcggactggggtgggtgccccgcctctatccacggttagcgtccccgcctacgtggatggagattggtactttggggagggaagaacgccactggctagcttgacgagccttcgcagaaggtagcggctgcaggcgctctcgtcacgtgttgagaaacttggcgtttcggttgttgttatatgacaagagaccaatatctgaagttattggcccagcttgcgaggggttcgatgccatcctgttcccacgtcatattttctgttatatgctgaaagtcacaatctcatccgcctatagaaggcggcaaaacgtcgattgtgtcattggagcgcagcgctatggtctggtcgcgcaccgtgatgcgatatgagcgcataggctcaaaatcgtagcgaggcgcgaaccctggcccgcaaggctcgctaccagctcggcgaccgtggcggccggccgtaatgtcattgtctccgattcggtacctgtggttactcgcgcggctacgtggtttagcacattgacccgaattccgacggattggtccgggtgtcttaagcgcatcgattacgctcatcgggcgattgggctggacgaagttgggcttgtttatgctgtggccagcaggctacgaaggtcggtctcctgactcgagaaaaaaacaactgcggatttggttgtcggctgtcagcagggcaaggttgcagcttgcacagaaagcatgcgacactgacttgatgacgccaaactttccggacggtgtttcaaggcctgtgttaaccagccaaagttcagccggagtctagccttgcggcgccgggttctgtcacaactggggaaggaattggggccgtagtgctactctagcacgttatagtagtttagtgcgtcagtagtttagtgcgtcctcacattgtcattggtgcccagcgtccagctgtatctgccttgataacccgcaactgataagctccggttcagtacaaaaccgcaacagctcgacgacatgcttgcggccgcttgtctggttcaacaccgaattcgccttgaacagcgggagatctgtgtgattcattacggctaagccgggtcatcacgtcagcgagttgttcgcgacgggtgatggtcgtaaagttgttctggtccaccctgtccatagacatgtcgattcattccaggcccgcgtcagccagagtgccagcatttccgggtcagtcctacaccgttggtggtcaacgagctctctgggcggggacgcaaactggccgctgctgcgattacctcttcgaagtgccgggccaagagcgactcactaccggtgaaccggatgttggtgacgtcgagccgggtgaccgcgatgctcgtgagcctggtaagctcgtctcgctgcggcagttactggcctcgtagttatcctccaggtctgctgtaggtatgtgcaactagatgcaacgcagagttggtgagtgatacccgcagttcgttggctctcctgccgcatgtagtccactactagggctatcgcggcacgtccttgagcggaggcgtggtggttcatccggctctagtgtgtggccaggtattgttggcactcccgacgcggtcagtgtcatacgggtactcgttcgaatcgagttgacgagccgacttcgacgatgttttttgcccagcagaaccagcggaaccgggatgagcttggagttagtcaacgtcagcggaataccgacgatcgtgaccgccatcgccgcgacactgagcaggtgcctgatcgtcaaccataacccgaacggcagtactcagatggtgttgccgacgagagctctcgtcccggctcctggcttgttgactatcgtccggtcgaatggccacaacgcgtaagacgctatgcgcaaagcttcgaggccgaaggggatggtggacgattagcgagaagctgataattgctgcaagtaagtggcagaggaccaaccagaggctgccgaaaaccagttaggtgacgtgtttaggatcaggccgcatatctccttcagcggtagtgccaccctactgggtaacggctaatctgggtgcttcgcgggcaactgcccgagtaagattggaaactaacattgtgtcccgcctacgtaggcgggacgtttgttctgttgtccatcttagtgatctgttagacaagcaggtgagaccagtgccgaccggcaaggtgaagtggtatgacgccgacaaggggtttggcttcctttcacaggaggatggcgaagacgtctatgttcgctcgtcggcgttgcccgcgggtgtcgaggggctcaaagccgggcaacgggtagagtttggcgtggcttctggccggcgtgggccgcaagcattgagcctcaagttgattgatccgccaccgagctttgctcgccaagtgcgccgcgaggcgctggccgagcacaggcacagcccggatgaactgcacggcatggtcgaagatatgatcactttgctggagagcacggtgcagcccgaattgcgtaaaggccgctacccggatcgcaaaacggccaggagggtatctgaggtggtcaaggcggtggcccgcgagttcgacgcgtagtgggggtcttagtgggttgattagcttgaaggcagcgctgcgcagcgtcgtctttctcattgtggctggcttcctctcctagggtgccttgacttcttgtgcccgaggacacccgggtggcgtcaacgtaccgagttggcctccgacaggtcagtttcatcgacgagagcaatcctcagagtgtgtgtggcaccgggtattgaacgttttttcccgactcagggcccagatccatcggacaagccgttccattccagatgccgttttcaccaaactggacttctaccgcgaattgccgccggtgctcgacggttaccggaattcgctgatctggttctcgtatggccgcggaaataacgggcatgcagtacgtgtggtgttcttaggcactggccagtcgtgggtacgtggtggctgcaatcaatcattaccgtgccaacacttatcactcgatcatggattacctaactagcaaactttgtcagcggacaaaggacttgacctttaccgcgaatttctttgttggcaaatcagtttagaggtacattggtggactacaaaaggactacaaaaggattggagtggccgggcactcgtagggggattcacgtcgctgtggatcggcggtacgcgagtcaacactgagcaattcctggccttccagtagggcgtgaaaaaccatttagcgatcccagcagacattcgagaccagctaccgctggacgccgccccagcttttgacgtcacagacccacgaatcaaagtagtttttttgtgatggctcccggtgttctccagaacttaggtatggacgaggctggattgcatcagttgagactgcccgactatagcactgtctgtgcctatgacaccaattatcctccaagcggaagaccgaattcgctgcctccaacattttcctgcgccaagttcaacgtcctacccagcgatgtcgaccacgaggttttcggcgatgagtgcacccagggagaagcaacgagtttcccgaagcatacatcgatgctctgagtgtggactgccacgcaatccacaccgaaatcgccgaggctgaagcccagttcttcgcgactgtgtttggtggctgactagctgctgatgtctgaggccgatggcggtgtttcaagtctgtcgaccccggtacatgcagcttcgacacggcttatccacttcgttcggcagcgacgtgcaccagctcacagctgatggaagaacttatacctaatccttaggacatcggtgcattatagcatgtgggcagggagtggggtatccaaaacgttgtgctaagtcgttagtgatggggaagtaagtagaggttattcaggagaaagcacgaaccctcgccgaagcatactgtgaaagttgttggtatagagtagatttagtcaaaaaactgttctttggtcactttttccaactcgtacatccgtctcctaagccgttcgatgtcgaagcggctcgtacagccgcgtttttggaccagctgcagcagtttcttgtcgccgttgacgggagtgttatcgagtgcgatgcgcagattcctgatgaatacgtgaaagactttgtcggcctgggttgcttcggcatgcatgaatatacagaccggagtatggcggtttgcacatgtcgcaagtagcctacagctgtgcgctgatgatgactaccagcgttaccccagtctcggcgtactgtatatagtttaccagtttattggaattagccgaactactaaagcttgctgggatctcgtaacagaagcggatgttcttgccgcggtgtgccgctggtgccgtttctgcttatcgaagcgtagatccagcccgcctcgcctcggtggctacaccggtctacgataggcaagcctatgaactcgaaggtgttaagttgcggaccaccaacggttgtagtagcagaattgctggtggtcatggcccgagtatcccgcaacaaagggtatcgaggggagtcagccgtattcgtggtctaggctgattcactctgagggtcaccgtggagcggcgtaacaagtgcatgggactacggggcatcgaaaacggcggtaaaccaggctccatcgtgttagcatcctcgtcgaaaagttaatcgggctaggaaggtgacggcctgaagacttggccgtcaaaatggtcactgaagatcgcaggagaatagtccagctagtgcgcgccatggggcaagtcagttggcaaacatgaaacggttgccagtgagattgcattcatcgtcgccatcaattatgcaccgcaagcggtggtggagctgtctggccagatggtcgacgaagggtgtaacgacataaggatcgaaatggcgttggctaagttctggtttagtgagatggtctgccgtattgtttacgagctgatccaaacccggggtggacggggctacgtgacagccggatctctcgcggcgcgtggcgagcgtgcggtgacagccgagcggatgctgcggtaactgcggatcaaccgcatcttcgaaggatcaagcgatatcacatgctgctgttcatcgccagagaggcgcttgacacccgatttcactaccgaaggtgccctgacgaaacttaacgtcaagttgcaagaaaaagttacagttggcgtgaacgagttctatgcaaatctatgcaaaatagttgttgaaactagtctgtggcgaaggccaacagcccgcagcgtatacatagctagttcggtccgatcgctttctacctgtggtatgttgaacgttccccgagtaagttggcctgcacaaattttacgggatggcttgttggcaagtctttttggaacacgggcagggatttctggatcgcattgtcggtattggtgctgagctgttcgccatgtcggttgtgtgtgctgagtctcggtgtctgacagatcctatcgtcggtcaacaattatacgagctggactaaaaattttgcgaatattatgcgggcggaggagctcttctatgcgttatggaataataccgacagcagtcgatgttcaactgacaaaagtcgttctgcggggccgctatatctactggaggatgggctggtagattggcttaaggctattggaccgtaaatcacgtactgggaggtggtcgggtcgagcgagtccaatctggctctacggttttcacggtgtcctccttagtattaaggttgctccgatcacatttgtcacggtgcgtagtatgcaacctgttgggactgtttattcttggatccggttcatcttggcctggaagaggcggtattcttccgcgcgacacggctggcgtcccacggttggctaaccggccacaacgatcacgagccacaatgggaacgctgccaaggccatcgtcgtctccctgacggtgcctagcggccagagcacgaatgcgaaaaaagtgagaacaatccagtacatcggggtacaccgccgggaatcttgtagcttgactcggcatggtgttgcgggtatctgcgctggcagatgaggtagctgacgatgatcatcgcccacacaacatgaataacaacgacgtaatagttgtgatgagcgtaaaggcgctgatcactgcacctccagcgtagagcagtggtaagtaagttaagtcaacaacagtggagctatgagaatgtagggtgaccgccggcgttgttccgccgcggttaagtcggcggaacagcgctgaggcattaccttcgtttgcaagaccgaaaagcattcggccggaataggatatacaggaatttgccgaggaggtggcggagatcacgacgaagttaactatttacgctacagtggcaaattactgccagtgaaaatatcgctatgatatggtgactcaccgttcgtgaactaccttcaagagaagatggtggggattgccaggaaagcgccgacgtaaaagatcatcacctgtaacggcacggcattgactattcgaggaagggtgcagcgcgggtttgttgtctcagcggcggtaccgacgagttccacttcgatgtatgagaagaacgcgatctgcaaaccatttaccatacccatgaactcgaataggggaagaacccgccgtcattccagaaattttcaaccgtcgcgtgcttaccgtgcgatgaaacaaagctagccaccagcagaaacgcaccgaccactatgaggcagccaaccgtagctagctggaccaggcaagaccagaattcagtctacccgaaggcttgtgcacacttaacaagttgaacatcaacattagaccgattgtaaccagaccggtagccatgcgggcacgtctttccaccagaacctgagtagtccgtgatcgctaccatgtctgagctaccggtgacgatccgggcgaaccagtacgatcacaccatgaaaaagcctgctgttggccacaaaaagtcggacgtgaagtcggcgaacaactggtcgattcaagttcgacagaaacagctcgcccatagcgagcagcacgaagaacataaagaatccgatcatctcgtacaccacgagttactcccggactagcgacggagattgttaacccgaggcctatgaagaggccagtgccgatcgcttcttcgaattcgattaactgaatatgtatttttaggcaaggatccgacgcaggtgcggctactcggctaccgggtgctcaacggggacatcgtccgatatgtgtgatgtcttcatcaggtagcggctctcgtaagaggaccaattggatcacgattcgccggacagcgcgaagatgtctaaccggtgtttgttaggctgctttaattgtgctgaaaatattttaacacgcgtgtccctaggggaacattgtcaatatggcttcctatgttgccgggatttgctaattaacttgcgaaaaaatatcttactatctgcatcactgccgacggatatgattgctgtccggtagagaacggccgttattgactcgttgtcatcagcactagcggctactgggattggaagacattctctccatcggatttttagtcgaatcatggattaatgcagctgaatgttctatttcggtccggtgctcaagatccttccggttgcggtacgtttatttcaagtacttccccgactactccaaaggcataacgatcccagcgatcgttgacatactcaccggccgttatagaaatgtaacgatttggtgtgtatggcgctgaatttctccacggagtgggccgcttaccatcgcgaccgcgcacctcagctctacccggatcggctgcgggcttaggtcgatgaggtgagcaaaaaggacctgcacctaaatcaacacatggggtgtatccggtgtggctttgctggctcgcaacaggcctacaacggttgttcactgcgctgtactgggtgagcgattacttcaccagctggcgatacgtaagggatgacagcatcgtaaaagcagacgtccggctctagtaccaaactggcccgcttcgattccagtctatcacggggatttcaagtgcaacaggcgcaacctcagagagatgccagtgctatggtcttacgttcgtgatttgttccagacaccgggctttggcgataccgtcgacttcttccaaattaagcattactactacagttatgcacgccgatatccaacttatctgtagcgtgccaagggcctagaattggctgtatttctggttttacatgtccagagaactttggagaagtagaccttaatcgattatatcacgccacccggttcgtaacttgcgccgaaattgccgtcaaggctgtgattgggtaggcgagtatggttcggcggcaatcttggcataaaagtcagaacgttagtcgaaccaaccattccgtgtgcgggacatcgtgtacttcaccggcggggtcgaccaccaacgtcagcaactgcacgactattccggtcagccgcccgcggtgcgggtcgagggtggggatggtcaccgctagtcgagtgttcggccgatagagagtgctggtggtgccggtcgggtcttcatagattcgcagcagtcgccagggcgctcggctaatcgtttcaggaaccgagagctgcactggattgtgttcgtccgccgataacacgccttgcgcttgcggtgtctgacactcgtcgaggttgagcatgttgcagtgtaggtacggccccacgcgagtcaagtgtccgtgtgaatagacgctgatctcaggtcgttgtggatcgggctcgcgcaccagcagccatacgccgaacccggccgcggcggctagcagcatcaccacggccgggagcagcacggttacccggcgttgcaccagggtctcattgaggactcaccgccgcggcgcggcgcatgctctcctgctcaatcatcaccggacgattacctccgaggcctggaattaacgaatcaccgcgaaagctcacgacggtttgcgctagacctaggatcagcaaggcactgaccgcggtgaatccgacccacaaatcggtgtacaccatcacgcctagtgctccgcctagcacccatgctagttgcagcgttgattctgaacggccgaatcccgatgctcgtgactcctcaggcaaatcattttgcaacgaggcgtccaacgaagccttcgcaattgcactagatcccgatgtgatcagggtagcgatagtagtcatcagtagattgccagccactgacgccgctaaggctaacacagtgaccgcgattgtgcagcgcaccaccagcacggccggcctgcccagctgcaggcgtgcgctggtgaaattgccagcgaagttgccgatcgcggcagcagtgccgatcaagcccagcatccccagctggacccagccattggcttgatgctctttggcgacaaacgcaggatataagaataggaagccgaccatcactttgatggtgcaattgccccacaacgaggtaatgatattgcggcccaacggttgtcgaagtctgccgctgaccttcttgacttcctcaggccagctctgtcgcaatggtttgcgatgcaagcgatagctcaaagtggctggaatttcacccgcggttacctcgacccagcgcggaatccgcattgacagcaaggcgccggagatcgtgatcgcggcgacgacgaacaatgcgccaggcagcttgaacaggtgggcgcagacgaactcgacaccggccgcgatggcgccaccggcgatggtgccgccgagcagaccgaacacggtcagccgagaattgacgcgtaccagatcaatgctgggcggcatcactcttggtgtgacagcgctgcgcagcacgctgaacgatttcgacaacaccatcatggccagcgcgcacgggtagagcaccatggacgggtagctgccggtggcgccgtcgtagttcatgatcagtagtgttgccaatccggtgcgtagcacgaatgaggttgccagcgccacgcggcggccgtgctgcagccggtctagcgccggaccgatgagcggcgcgatcaccgcgaacggagcgatggtgatcagcaggtacagcgcgactttggatttgctctccccgctggccgcggcgaagaacaaagtgttggccagtgcaacggccattgcggagtctaccgcaaagttcgtgaccaccggccacgtcaatgcagttagcccggatttgtcagcgccgtcagcggtgcggcacgctgaaccatccagtacattcggtagcccatttcacggcttcgctggcggcagcgcgagtgaccttaattcgttcaccagggtacggaccgcatggtggcgcactgttgtgttggggttctgactgctgctggcccaggggcgggagatagcggttggcgctgggcatcgacggcgagcggcgcgctgggtccaactgcccggcttgttgttcgcgctgttccagcgctctccgttgctgggctggccgaaagtcagagctgtcggccgggtagttcgcaatgcctggatgctggttacgcgagccggtgcgggtccggaggcctggtatagaggccaaacggcccggatgattacgccgccgtccagacacgaatcaattctgtcctatgtcgacttcatgcgtgtgcaggaggccgggtgtcgcttgcaaactgtgtcttccggcagaattggattatgggttgcaaagaggaggtagcgtgactgggcctgtcgaggattccgccgtcgcgaccgtggctgagtggcccgaagaattggcggcggtgctcacgaatgcggccgacgatgccagggcggctattgaggagttcagcggttctgtgacggttggggactacttaggagtcggttacgaagatccgaatgccgccactcaccggttcttggcgcatttgcccggttaccagggatggcagtgggcggttgtcgtcgctgcttatcctggtgccgagcacgccacggtgagtgaagtggtactggtccccgggccgacggcgctgctcgcgccagagtgggtgccgtgggaacagcgggtcagaccgggggatttgggcccgggggatctgcttgcgccgacatcggaggacttacggttggttcctggttacaacgccagtggtgacccggcggtggacgagatcgccgccgaaattgggttgggtcgacgctgggtaatgagtgtctggggtcggtcggcggcggccgagcggtggcatggtggcgattacggtcccgactcgccgatggcgcggtccaccaagcgtgtgtgccgcgattgcggtttctttctgtcgctggtgggatcgcttggcgcgatgttcggggtatgcggcaacgaaatgtccgccgacgggcatgttgtcgacaagttgtacggttgtggtgctcattccgacaccccggctccagcgggcagcggctcatccgtgtatgagccgtacgacgacggtgtcctcgacattttggagccgtctacagtgcagcttccagagtccccggcggactagccttttcgactggtggtgctcagtcatcgtggtggtatggcgtggtcggtcgaatgggctgatccggtagcgcggggatgtagggttttttgacttgccgaccttggcaagctatctcgggtcgagataggtttcgagtccgccttggtcgcctcgtgcgccgcggcgggcagcggcaagttgccacacgaaaatcccggtaccaaacaatccgacgaccagtccggccaatgccactgggcgccaactctgtaggctcgacaccacgaacgcagcgaccacagcgatcagccaggctagagcgccgaccattataaccggccagacctcgagcagcatggacggtagcggaggcggctcgcggcttctatcaggttcgaccagcatcttatccaatttagctcggcaacgaagtacacggtgctgcggcctgaggtgatgtcccacactcgtgggagagagctgggcacttagctagaccgggcgtcaatgaaaaacgtcggcaattgcagcagcacagcgaaaaggatcgaagtccgtcgttcgtcgtttctgacccgaattcttaggttccgatgtaacctcgcgccatgcttgacagcgatgcgcggctggccagcgacttatcattggccgtaatgcggctggcccgccaactacggttccggaacccgcaatcgccggtgtcgctgtcgcagctgtctgcgctgacgacgttggccaacgagggcgccatgacgcctggcgccttagcgattcgcgaacgagtccggccaccgtcgatgactcgggtgatcgcatcgttggctgatatggggttcgtggaccgtgagccacaccctgtcgatgggcgacaagtgctggtctcggtatcgcagtccggtgccgaattggttaaggcagcccggcgcgcccgccaggaatggctggtcgagcggctgatgacgctgaatagcgataaacgtgacatcctgcgcaatgccgccgatctgatcttggagttgattgacgaaagcccgtgacctcacgcttttatggcgttgctggtctgtatgaactcgatgttcaaggcgtcaacaatcctgaggatccgcaactcgatgattttcgcgacttgaacagcatcgatcgtcgttcggatctgccgaccggcagaggactggtaggactggtaatcgtcgagtgcgtgctggttgtacggcgcatgctagcgtccccatttaggctgggtatcgaccgcagattggttgagcgcaaggacgatctggccgatgccagcgacattcaggtgccctactatacaagtgtacgccggtgtcaatgactcgggtggttggcttccacctcaaccgtggagtgttggccgccgtgagatgggtgcccgagccaagtgtggcgcaggtggtcgtcggagcccggaaggtagcggtgctcgaggatgtcaacaaccacgagaacctgggttcaatatttcgcaacgcggtggggttgggagtggacacggtggtgttcggccccggctgcgctgatctgctacactagcgtgtggtacaggtatttatgggctcacgctttgatttttactgtggtctgcccgacgagcaaccggctggctcgtcggtttcgtgactctaaacaaaggacgatgctttctcgtgttgacgatgactccaaaccgcgaagcgtgcgcgctgccggaggtgatgacggcggtgcgcgatgaatggattgcagtgctggtagggtgcagagggtccgggattgacctctattctgcggttagttaaggcgtatgccggttcgtatcctaatgtcgcggggcattgactcgctaatgccgcttcggctgtgggtcttctactagagggttaaggttcggcgacgatgaacttcgcggccaggagtgaagggagtcgagcgatcaggctcggcttgggcttgtgagtgcttgtgagtgagaggggcagcgagcacgaccaatctcagtcctgggcaacgatttgacggtgggcagggtattgatgtcgtggttattgtctccggggtcgtggtgctgagtgtctcggcctgattcgggtacatccgctgttggcagtcgggcttaacatcgtcgtgggtggcgggctggcgccgacgttgtggggttagcggcgcaccgcgatcttgtgctaagcacgggaattggtgtgacggggggtgttgctgagacgctgctcgtattgattgcattgggtcgggtctaccggtctgggctggtttatcaagtcatcagcgctgcccggctgagcgcactccgagcaggacatcctcccaagctggaatggtgggcttgcctcgtcggctgctcactagttggttgtccggcgtgacggtcgccggtgtcgcgggttcaacaaagtcgaggtgtgctacccgtgccagcgggcgtaacggacggttaaagtccgggtcaatgagttcattagccgcgtcatcgcttgcggttacggttccgccgtgagcgccgggagtgaagcagaaatgtgcgaggttgtcggaacggccggcatgccacatgagttgcactgtccagcggctgtcttcattgcgccaggcgtcccagctcagcttgtctggttcgaggccacgcttcaccgcgcagcgctgacggtctccaagagtgtcagcacggccggccatcggcgaggactggatgtgcggcagtggccagctcagctgcgcgtgaacgttctaacagcaccgggtgggcgaatcggcggatccgcgcgatgtcggaccccgacgccatggccacctgttcgacggagggcgccagcccgaattcgggcctgaatttctttagggctcagcatgttggtgacttggatgtcgagctgcggttggtccagcaacgtcgtgtcgccg

SEQ ID NO: 27 - protein, 116 aa, MYCOBACTERIUM LEPRAE
  hypothetical: YES
MQPGGDMSALLAQAQQMQQKLLETQQQLANAQVHGQGGGGLVEVVVKGSGEVVSVAIDPKVVDPGDIETLQDLIVGAMADASKQVTKLAQERLGALTSAMRPTAPPPTPPTYMAGT

SEQ ID NO: 28 - protein, 351 aa, MYCOBACTERIUM LEPRAE
  hypothetical: YES
MATRGLAIGVVGATGQVGHVMRTLLEQRDFRADSVRFFASARSQGRKLAFRGQKIEVEDAETADPTGLDIALFSAGASMSRVQAPRFAAAGVTVIDNSSAWRRDAQVPLVVSEVNYNRDVRDAFPLPKGIIANPNCTTMVSMPVLKVLHDEAQLLRMVVSSYQAVSGSGLAGVAELAAQVRAVIDVAEQLIHDGGVVQFPAPSKYVAPIAFNVVPLAGSLVDDDSGETDEDQKLRFESCKILGIPDLLVSGTCVRVPVFTGHSLSINAEFARPLSPQRARDLLGGAPGVKLVDVPTPLASAGVDESLVGRIRRDPGVPDGRGLALFVSGDNLRKGAALNAIQIAELLATQL

SEQ ID NO: 29 - protein, 488 aa, MYCOBACTERIUM LEPRAE
  hypothetical: YES
VIFDHNGAEVARHQLEHEQILPRSGWVEHNPVEIWERTASVLMSVLNATNLSAKDIAALGITNQRETTLVWNRNTGRPYCNAIVWQDTRTDRIAVALDRDGRGEVIRRKAGLPPATYFSGGKLQWILENVDGVGAAAENGEALFGTPDTWLLWNLTGGPRGGVHVTDVTNASRTMLMDLEKLDWDDELLSFFSIPRAMLPAIASSSPLQPYGVTLADGPVGGEVPITGVLGDQHAAMVGQVCLDAGEAKNTYGTGNFLLLNTGEAIVRSGNGLLTTVCYQFGDAKPVYALEGSIAVTGSAVQWLRDQLGIISGAAQSESLARQVVDNGGVYFVPAFSGLFSPYWRSDARGAIVGLSRFNTNAHLARATLEAICYQSRDVVDAMAADSGVRLDVLKVDGGITSNDLCMQIQADVLGVDVVRSVVAETTALGSAYAAGLAVGFWAGPSDLRANWQEDKRWTPTWGEDQRAAAYAGWRKAVQRTLDWVDVS

SEQ ID NO: 30 - protein, 421 aa, MYCOBACTERIUM LEPRAE
  hypothetical: YES
VALVVQKYGGSSVADADRIRRVAERIVQTKKQGNDIVVVVSAMGDTTDDLLDLAQQVCPEPPARELDMLLTAGERISNALVAMAIESFGAQARSFTGSQAGVITTGTHGNAKIIDVTPTRLQFALDEGRIVLVAGFQGVSQDTRDITTLGRGGSDTTAIAMAAALGADVCEIYTDVDGIFSADPRVVHNARKLDTVTFEEMLEMAACGAKVLMLRCVEYARRHNIPVHVRSSYADKPGTVIVGSIKDVPMEDPILTGVAHDRSEAKVTIVGIPDIPGYAAKVFRAVADADVNIDMVLQNVSKVEDGKTDITFTCSRDSGPIAVAKLGSLRDEIGFTQLLYDDHIGKVSLIGAGMRSHPGVTATFCEALAAVGVNIELISTSEIRISVLCRDTELDKAVFALHEAFGLGGEDEVTVYAGTGR

SEQ ID NO: 31 - protein, 203 aa, MYCOBACTERIUM LEPRAE
  hypothetical: YES
VFEGPVQNLIDELGKLPGIGPKSAQRIAFHLLSVEPQDIDRLTAVLVKVRDDVRFCTVCGNVSDDERCRICSDTRRDASVVCVVEEPKDVQAVERTREFRGRYHVLGGALDPLSGIGPEQLRIRELLSRIGERVDDVGITEVIIATDPNTEGEATATYLVRMLRDMPGLTVTRIASGLPMGGDLEFADELTLGRALTGRRTMV

SEQ ID NO: 32 - protein, 572 aa, MYCOBACTERIUM LEPRAE
  hypothetical: YES
VESPTSYIDASLPVPAVRQGSRAYPAVDRTWPDRVIDCAPLWCAVDLRDGNQALIDPMSPICKRRMFDLLVRMGYKEIEVGFPSASQTDFDFVREIITDGTIPDDVTIQVLTQCRPELIERTFEACENASRVIVHFYNSTSILQRRVVFRADQATVKAIATDGARKCVEEAFKYPGTHWRFEYSPESYTGTELEYAKQVCDAVGEVIQPTPDNPIIFNLPATVEMATPNVYADSIEWMSRNLANRESVILSLHPHNDRGTAVAAAELGYHAGADRIEGCLFGNGERTGNVCLVTLGLNLFSRGVDPQIDFSNIDEIRRTVEYCNKLRVHERHPYGGDLVYTAFSGSHQDAINKGLDQMKIDADAADSDVDDILWQVPYLPIDPRDVGRTYEAVIRVNSQSGKGGVAYIMKADHGLELPRRLQIEFSRAIQKISEGEGGEITPTEMWDVFFEEYLSPVQPLERIKQRVNAAEEDGGSTSIAATVKINGEETEISGVGNGPLAAFIDALGHVGLQVAVLDYSEHAMNAGDDAQAAAYVEASVHGHTAWGVGIAPSITTASLRAVVSAVNRAMPR

SEQ ID NO: 33 - protein, 821 aa, MYCOBACTERIUM LEPRAE
  hypothetical: YES
MSERLPAVLAVLKLAGYCLLAGVVTTAMMFPLAGGLGVISNRASEVVANGSAQLLEGEVPAVSTMVDAKGNTIAWLYSQRRFEVPTDKIANTMKLAIVSIEDKRFTDHNGVDWPGTLTGLAGYDSGDVDTRGGSTIEQQYVKNYQLLVTAQTDAEKRAAVETTPARKLREIRIALTLDKTFTKPEILTRYLNLVSFGNNSFGVQDAAQTYFGVNASDLNWQQAALLAGMVQSTSTLNPYTNPEGALARRNLVLDTMIENLPQDAEALRAAKTEPLGILPRPNELPRGCIAAGDRAFFCDYVQEYLSHAGISKDRLAKGGYLIRTTLDPNVQAPVKAAIDKFASPNLAGISSVMSVITPGKDAHRVIAMGSNRRYGLDTEAGETMRPQTFSLVGDGAGSVFKIFTTAAALDMGMGINAKLEVPSRFQAKGMGSGGAKGCPKETWCVINAGNYRGSMNVTDALATSPNTAFAKLIQQVGVARTVDMAIKLGLRSYTTPGTARDYNPDSNESLADFVKRQNIGSFTLGPIKVNALELSNVAATLASGGMWCPPNPIDKLFDRNGNEVAVTVETCDRVVPEGLANTLANAMSKDTKGSGTAAGSAGAAGWDLPMSGKTGTTEAHRSSGFVGFTNHYAAANYIYDDSTSPTNLCSGPLRHCSNGDLYGGNEPARTWFTAMKPIATKFGEVRLPPTDPRYVDGSPGSQVPSVTGLDLDAARQRLKGAGFQVADQPTLINSTAKLGAVVGTTPSGQTIPGSIITIQTSSGIPPAPPAAGRRPADATLGWIAGHRNSRLAANHHSATSASVNPQRALCQRTCVVLSVRD

SEQ ID NO: 34 - protein, 285 aa, MYCOBACTERIUM LEPRAE
  hypothetical: YES
MTAPTSHRPPTLDMAAILADTSNRVVVCCGAGGVGKTTTAAAMALQAAEYGRTVVVLTIDPAKRLAQALGVNDLGNTPQRVPLAPEVPGELHAMMLDMRRTFDEMVVQYSGPERAQAILNSEFYQTVATSLAGTQEYMAMEKLGQLLSQDRWDLVVVDTPPSRNALDFLDAPKRLGNFMNSRLGRLLLTPGRGIGRLVTGAMGLAMRALSTVLGSQMLADAATFVQSLDATFGGFRGKADRTYALLKQRGTQFVVVSAAEPDALREASFFVDRLSQENMPLAGSC

SEQ ID NO: 35 - protein, 341 aa, MYCOBACTERIUM LEPRAE
  hypothetical: YES
MVTPTSGKDSAIGWPTRLSKARLHLVTGKGGTGKSTIAAALALTLAAGGRKVLLIEVEGRQGIAQLFDVPPLPYQELKIATAAGGGQVNALAIDIEAAFLEYLDMFYNLGLAGRAMRRIGAIEFATTIAPGLRDVLLTGKIKESVVRINKGAKNPVYDAIVVDAPPTGRITRFLDVTKAVSNLAKDGPVHSQSQGVVELLHSDQTAIHLVTLLEALPVQETLEAIQELADMELPIGSVIVNRNIPCYLGHHDLAKVAEGDIDADTVRKGLAMAGIKLNDADFAGLLTETIQYAMVITTRAEAAQQLDTLQVPRLDLPAISDGVDLGNLYELSESLAQQGVR

SEQ ID NO: 36 - protein, 285 aa, MYCOBACTERIUM LEPRAE; identical to SEQ ID NO: 34
  hypothetical: YES

SEQ ID NO: 37 - protein, 97 aa, MYCOBACTERIUM LEPRAE
  hypothetical: YES
MLNRTHPTLCALPVEQAIDASKTLQDEITNSAAASLATAVLRIHADRGQTAKREARLLSRFTGANPHVPVIGIPLLPFDVSDLEALRAIADRLTASH

SEQ ID NO: 38 - protein, 369 aa, MYCOBACTERIUM LEPRAE
  hypothetical: YES
MADTRLTTPLSPSPLRCWRRLHTGPAARAKVRGHRAWPILIRTGALVLSSAATGAGYASIVERNAFVLRELTIPILTPGSTPLRVLHISDIHMMPHQRRKQAWLRDLATWQPDLVVNTGDNLAHPKAVPGVIQALGNLLSRPGVFVFGSNDYFGPHLKNPVNYLTNPTHRVRGKPLPWKDLRAAFTERGWLDLTHTRREFEVAGLHIAAAGVDDPHISRDRYDTIAGPASPVANLRLGLTHSPEPRVLDRFAADCYQLVMAGHTHGGQLCLPFYGALVTNCGLDRSRAKGLSRWDADMRLHVSAGIGTSPLAPMRFCCRPEATLLTLIATPMGSRVESPVRTGAVRNQQLQCVERAHRDSGPRPPTQLD

SEQ ID NO: 39 - protein, 104 aa, MYCOBACTERIUM LEPRAE
  hypothetical: YES
VIETGTGGTSATIVRSIRYRRYGTYAKVRYDIVMPTSSCIEGIGRPLAEPSFLPAGGRPACSRFQTQHRSSPPAGNVRPAHRDGSHNRSVVTLLDDSGNHYVDP

SEQ ID NO: 40 - protein, 196 aa, MYCOBACTERIUM LEPRAE
  hypothetical: YES
MGLRVVSDDGSPEHFRQALFRVLASVVEIWMLLGSPAVICSMLSPKAKHIGDIFPGTVVISERRPQRGPSPAMPPSLAWWASSLQLSGLNTRQAELAHQFLSRAPQLDPQLQEQMAYRITGDVMSRIAPPPPSSTPPQLMLAAVLAERHRHKLVQLRPTPVGPTPSSPTVSKYPVPPRVAWAGICSTQFLVASGHR

SEQ ID NO: 41 - protein, 199 aa, MYCOBACTERIUM LEPRAE
  hypothetical: YES
MASASQTQRITNMNDPFLPPNGPFAAEPSLGFGFSPGPGPEFSFSFGPRRRGDAGRGRRGDVRAAILMLLTERPMHGYQMIQQIAERSNGIWRPSPGSVYPTLQLLSDKNLITASATDGSKKLFELTDDGRAAAKVEMPPWDQIAQGINPGYINLRTAMNQLFGAVTQSAHTASADQQQRIIDTINNARREIYGILGEN

SEQ ID NO: 42 - protein, 80 aa, MYCOBACTERIUM LEPRAE
  hypothetical: YES
MFDPAGAGQDLLVLKLVAGHLSTIMIENHAAGAGGALVDGGYEFSELGQLRSFDVNCDTSWSMMVYHPAYSSSGQPVILT

SEQ ID NO: 43 - protein, 83 aa, MYCOBACTERIUM LEPRAE
  hypothetical: YES
MRTSLNDAEAKSNSSVTHIVMIGILPTLSDRQLDELFSAVYGLQESDLPRLLLENRCCQPELNVVYMSANSAFHYGALHNMSE

SEQ ID NO: 44 - protein, 124 aa, MYCOBACTERIUM LEPRAE
  hypothetical: YES
MKSTRPTTALPPAATATSPLEHSAPDSCLYVTRKQRRRGHRHQAANTPVVEAATAILATLIAEPILAKSFAAIATYLSPNCNLQYPYLPRSIVINNCPKRYRIEPGRETTLTLTFFAAVFSGIR

SEQ ID NO: 45 - protein, 382 aa, MYCOBACTERIUM LEPRAE
  hypothetical: YES
MIGGLVAITLDRSILSQLGAGRRTIVVTGTNGKSTTTRMTVDALSTLAPGSVATNAEGANMDAGLVAALAANRAATLAVLEVDEMHVPRVADALTPHIVVLLNLSRDQLDRVGEINVIERTLRTGLARHPTAVVIANCDDVLMTSVAYDSPNVVWVAAGGTWSNDSVSCPRSGEVIVRKNRHWYSTGADFKRPSPHWWFDDNTLYGPDELALPMRLALPGSVNRGNAAQAVATAVMLGADATTAVAAVSKVDEVAGRYRSVRIGEHTTRILLAKNPAGWQEALSMVDTQAAGVVISINGQVPDGKDLSWLWDVRFEHFEKIPVVAAGERGTDLAVRLRYAGVEHTLVHDTVAAIASCPPGQVEVVANYTAFRQLQRRLARHG

SEQ ID NO: 46 - protein, 235 aa, MYCOBACTERIUM LEPRAE
  hypothetical: YES
MADSTVRIGLVLPDVMGTYGDGGNAVVLRQRLPLRGIAAEIVELTLADPVPESLDLYTLGGAEDYAQRLATRHLLRYPGLQHAASYGAPVLAICAAVQVLGQWYETASRERVDGVGLLDVTTAPQDVRTIGELVSTPLLTSLNQRLSGFENHRGGTVLGPAATPLGAVVKGAGNRVGDHFDGVIQGSVMATYMHGPCLARNPELADLLLSKVVGELAPLELPEVELLRRERLAAR

SEQ ID NO: 47 - protein, 459 aa, MYCOBACTERIUM LEPRAE
  hypothetical: YES
MVSVQESALVVYTSGVKRLVASYRSIPATSPVRLAKPTSNLFRTRAKRDAPGLDASGLTGVIGIDTEARTADVAGMCTYEDLVAATLPYGLLPLVVPQLKTITLGGAVTGLGIESASFRNGLPHESVLEMDILTGAGELLTVSANQHGDLYRAFPNSYGTLGYSTRFRISLEPVTPFVALRHIRFHLLTEMVTAMENIIDTGGHDGVPVDYLDGVVFSANESYLCIGKRTTTPGPVSDYTGQHIYYRSIQHDNEVKEDRLTIHDYVWRWDTDWFWCSRAFGAQNQQLRRWWPRRYRRSSVYWKLMAADRRFGIVDRIEARNGRPLRERVVQDVELPIERTCEFLEWFLGSVPIAPIWLCPLRLRDHNSWPLYPIQPDHSYVNVGFWSSVPAGATEGETNRTIEAKVSALDGHKSLYSDSFYTREEFNELYGGESYNAVKKIYDPDSRLLDLYAKVVQRR

SEQ ID NO: 48 - protein, 439 aa, MYCOBACTERIUM LEPRAE
  hypothetical: YES
MTTTKDSERFTQISSGKLTMAEILGILTATGQQPLKFTAYDGSTAGHDDAEIGLDLCSPRGATYLATAPGELGIARAYVAGDLQARGVHPGDPYTLLKTLTDRVQFKRPSLRVLASVVRSLGVEHLLPIAPPPQETPPRWRRITDGLLHSKTRDAEAIRHHYDVSNRFYEWVLGPSMTYTCAVYPNAEATLEEAQENKYRLIFEKLRLQPGDRLLDVGCGWGGMVRYAARRGVRVIGATLSAEQAKWARKAIDNEGLAEIAQVRYSDYRDIRETEFDAVSSIGLTEHIGVKNYPAYFNFLKLKLRTGGLLLNHCITRRDNKSTSFAGGFTDRYVFPDGELTGSGRITTEIQEVGLEVLHEENFRHHYAMTLRDWCHNLVEHWEDAVAEVGLPIAKVWGLYMAASRVAFEQNNLQLHHILATKVDVWGDNSLPTRPWWTP

SEQ ID NO: 49 - protein, 206 aa, MYCOBACTERIUM LEPRAE
  hypothetical: YES
MVMSVGLGLGVPVASARPSEPGVVSYAVLGKGSVGNIIGRPMGWESLLTEPLQAYSVDLPMCNNWADIGLPEVYHDVDLASFNGAITQTSANDQTHFVKQAVGVFATNDAAVRAFHRVVDRTVGCSGQTTAMHLDNGTTQVWSFVGGTPTYADANWTKQEAGTDRRCFVQTRLRENVLLQTKVCQPGNAGPAVNVLAGAMQNALGQ

SEQ ID NO: 50 - protein, 382 aa, MYCOBACTERIUM LEPRAE
  hypothetical: YES
VSFARLVECSWYAALCLFVAQAFSVASWIAHADPPAPVPEPILQPLVPGQVLRIGPMAGTGTRTGDYGIGATDLCEFIEFPAELLQICGDSFAGQGVGFGGWYSPVALHVDTASVDDPTGVRYIGVTGVDKPLLADPAPPGDSQLPAGVVQINRHNYLMVTTTKNLEPQDSRLVTAEPARVGWQTVPGSRRAATSQDSRQTQISGYYDPIPTPDSSSGWVYIVANSFTRRDSVQLFRVTPQTFTDRSRWQGWAAGPDGGWNKPPTPLWPDKVGEMCIKQIGGQAVLSYFNATTGNMEVRVAADPTLLGTSPVTTVVQHDEWPDPAESLPPPYDNRLAQPYGGYISPGSTLDELRIFVSQWDTRARVSELYRVIQFAVNPLKP

SEQ ID NO: 51 - protein, 145 aa, MYCOBACTERIUM LEPRAE
  hypothetical: YES
MGPVSAVSTILVNVEPVATLAAVADYQKMRPKILSPQYNEYQVVQGGQGPGTVVKWKLQVTRSRVRDVQVNVDVAGHTVIEKDANSSMVTSWTVAPAGPGSSVTMKTAWTGAGGVKGFFEKTFAPLGLKKIQAEVLANLKNELER

SEQ ID NO: 52 - protein, 457 aa, MYCOBACTERIUM LEPRAE
  hypothetical: YES
VLSRSGLVGAATSVAERVGGARLVAVLATPTASTVLAITGCLIAGVPVVPVPADIGVVERRHMLTDSGAQAWLGPGPSADSAPDGLPHIPVQLDARSWNRYPEPSPDATAMVIYTSGTTGPPKGVLLSRRAIAVDLDALAQAWQWTADDVLVHGLPLFHVHGLVLGLLGSLRIGNRFVHTGKPTPTAYAQACSEAGGSLYFGVPTVWSRLVADEAVARALRPARLLVSGSASLPVPVFDRLAHLTGHRPIERYGSTESLITLSTLADGERRAGWVGLPLAGVQTRLVDESGGPVPYDGETVGRLQVRSPTMFGGYLNRPEATAEAFDEDGWYRTGDVAVVDSGGMHRIVGRESVDLIKLGGYRIGAGEIEMALLGHPDVREVAVVGLPDEDLGQRIVAFVVGAEALDADELINYVAQQLSIHKRPREVRFVDALPATRWERSSKSSCSSRADWRYDE

SEQ ID NO: 53 - protein, 264 aa, MYCOBACTERIUM LEPRAE
  hypothetical: YES
VQSMLCGRPVAADRQLIMAIVNRTPDSFYDRGATFSDEAARAAAHRAVAEGADVIDVGGVKAGPGQGVDVDTEIARLVPFIEWLRSAYTDLLISVDTWRAEVARLACTAGADLINDSWGGADPAMHEVAAELGAGLVCSHTGGALPRTRPFRVSYGTTTRGVVDDVIRQVTAAAERAVAAGVTRDSVLVDPTHDFGKNTFHGLLLLRHVDELVKTGWPVLMSLSNKDFVGETLGVGLTERLEGTLAATALARQLASACFGCTRS

SEQ ID NO: 54 - protein, 192 aa, MYCOBACTERIUM LEPRAE
  hypothetical: YES
VSDDGLVRCGWADVRSGLHWQLYRNYHDQEWGSPVRCGVALFERMSLEAFQSGLSWLLILRKRENFRRAFSGFDIEEVARYTHADVQRLLFDDGIVRNRVKIEATIANARAAAELGSAADLSELLWSFAPQPRSRPADGSEIPSTSAEAKAMARELKRRGFRFVGPTTAYALMQATGMVDDHICTCWVPPTR

SEQ ID NO: 55 - protein, 419 aa, MYCOBACTERIUM LEPRAE
  hypothetical: YES
MPPWQRWAAADRFGAMREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 56 - protein, 736 aa, MYCOBACTERIUM LEPRAE
  hypothetical: YES
VLRKHTSSVQCARIDADCREVFGDVLGEHAMTIRLCGSWSVGDIEANYMMYSRIAGHCCRPVFVTHRRLTLPKRWLGYPFGAPTLALPEYNNGMLEQIRRPADLQHLSQQQLRDLAAEIRELLVHKVAATGGHLGPNLGVVELTLALHRVFDSPHDPIIFDTGHQAYVHKMLTGRCQDFDSLRKKAGLSGYPSRAESEHDWVESSHASTALSYADGLAKAFELAGNRNRHVVAVVGDGALTGGMCWEALNNIAATPRPVVIVVNDNGRSYAPTIGGVADHLATLRLQPAYERLLEKGRDALHSLPLIGQIAYRFMHSVKAGIKDSLSPQLLFTDLGLKYVGPVDGHDEHAVEVALRKARGFGGPVIVHVVTRKGMGYPPAEADQAEQMHTCGVMDPTTGQPTKIAAPDWTAIFSDALIGYAMKRRDIVAITAAMPGPTGLTAFGQCFPDRLFDVGIAEQHAMTSAAGLAMGRMHPVVAIYSTFLNRAFDQIMMDVALHKLPVTMVIDRAGITGSDGPSHNGMWDLSMLGIVPGMRVAAPRDAIRLREELGEALDVDDGPTAIRFPKGDVCEDIPALKRRSGVDVLAVPATGLAQDVLLVGVGVFASMALAVAKRLHNQGIGVTVIDPRWVLPVCDGVLELAHTHKLIVTLEDNGVNGGVGAAVSTALRQVEIDTPCRDVGLPQEFYDHASRSEVLADLGLTDQDVARRITGWVVAFGHCGSGDDAGQYGPRSSQTM

SEQ ID NO: 57 - protein, 204 aa, MYCOBACTERIUM LEPRAE
  hypothetical: YES
MFDFAALSPETNSTRMYLGPGSSPILTAAAAWVVLAKELTAAAQGLQSAVEALLTTFEGESAAALAERVTPYEKWLTQNAASAELTATQLTVAANAYETAFTMTVPPLMVFVNRAQACLLIMSNIFGQNSTAIAEKEAEYTEMWIQDAAAMTSYQASVLEAVGATKANRRRCWGAGYRWHLWSLAEAAVLAASTLHYACNQELS

SEQ ID NO: 58 - protein, 363 aa, MYCOBACTERIUM LEPRAE
  hypothetical: YES
VAVLRSMSTRRELLESPYLAAVSGRKPCRVPVWFMRQAGRSLPEYRALRERYSMLAACFEPEVACEITLQPLRRYDVDAAILFSDIVVPLCAAGIDLDIVPDVGPVIGDPVRTATDIHAMKPLEPQAIQPIFQAISLLVAALGDVPLIGFAGAPFTLASYLVEGGPSRNHPRTKAMMLAEPASWHTLMDKLTDLTLGFLLGQIDAGVDAIQVFDSWAGTLSLSDYRQYVLPHSARIFATVAEHGVPMTHFGVGTADLLGAMSAAVRSGEKPGHQAVVGVDWRTSLTDAAARVEPCTALQGNLDPVVLLAGWPAVERVARTVVDDGRRAVVAGAAGHVFNLGHGVLPETDPGVLSELVSFIHSL

SEQ ID NO: 59 - protein, 155 aa, MYCOBACTERIUM LEPRAE
  hypothetical: YES
VGDLPPRLALAPACGMRMVNLFAIPMPGAHHRSRRIRTEVPNLIFLPIKWAYSPELILFVLTMQTAACSGYLAASQAFNVAALHAVSDLQWTCEILSHLLCCGCEDRCGGGNATVRRSHMSVSQPTTSPPRPEWSPRVLAATLALGRHANIPRLH

SEQ ID NO: 60 - protein, 234 aa, MYCOBACTERIUM LEPRAE
  hypothetical: YES
VGIVDDKQQIARRRFVFRLNDARAAHHNAAGFPIWVMSAGWLKAPNGTALGWGADNLADDGARVATDELFSGQAGQDGLADAIGSKYNGTHPETMSGGCQLDMAERGDLIPDYDNLTEGKHTAAPRRPLVEGCSIESVLPDFSCVRAGWLCGWCNGPNGVGSTFERLCVRIAVNPMRGRFVSFARLDRCTRSCSNWPPNLVRRLLSAAGPWSGAVAAFQRWVRWRPRRGHAAVG

SEQ ID NO: 61 - protein, 187 aa, MYCOBACTERIUM LEPRAE
  hypothetical: YES
MRSDRGKPNAWAICVFCAAGPMHPELLELAAELGEAIAERGWTLVWGGGRVSAMGAVASAAWTRGGRIVGVIPEMLQRREIADTYVGELIVTETMAERKQVLDDHADAFIVLPGGLGTLDELFEAWTAGYLGMHRKPIVMLDPWGHYEGLWAWLHGLIDSGYVSPVAMERLVVVDQVDAALEACMSV

SEQ ID NO: 62 - protein, 80 aa, MYCOBACTERIUM LEPRAE
  hypothetical: YES
MAAFVDRLGDAFRWKGNKVATTQVEVVLTSDKSVEECMIFGIEVSCTAGCAGMAAIKRGEGAEFDGRFLARAVYGQLYAY

SEQ ID NO: 63 - protein, 319 aa, MYCOBACTERIUM LEPRAE
  hypothetical: YES
MTASELIASALAARSGDAWLADRSWSRPAWTIDELVAAKAGRAISVVLPALNEEQTIESVIDSISPLVSDRAGLVDELIVLDSGSTDETEIRAIAAGARVVSCEQAMPEVPTRPGKGEALWRSLAVTSGDIVVFVDSDLINPHPMFVPWLVGPLLTGDGIHLVKGFYRRPLNSNDAGGSARATGGGRVTELVARPLLASLRPQLGYVLQPLSGEYAATRELLTALPFAPGYGVEIGLLVDTFDRLGLDAIAQVNLGVRAHRNRPLAELGAMSRQVIATLLSRCGILDSGVGLTQFFVDESDGDGYIRHTWSVSLADRPG

SEQ ID NO: 64 - protein, 114 aa, MYCOBACTERIUM LEPRAE
  hypothetical: YES
VALVLLYLVVLVLVAIVLFGAASLLFGRGERLPPLPRGTTATVLPAHGVTGADVDAVKFTQVLRGYKPSEVDWVLDRLGRELEALRGQLAAIADAEADADVSNVPSGDDGQDVT

SEQ ID NO: 65 - protein, 192 aa, MYCOBACTERIUM LEPRAE; identical to SEQ ID NO: 54
  hypothetical: YES

SEQ ID NO: 66 - protein, 55 aa, MYCOBACTERIUM LEPRAE
  hypothetical: YES
MAAMKPRTGDGPLEATKEGRGIVMRVPLEGGGRLVVELTPDEAAALSDELKGVTS

SEQ ID NO: 67 - protein, 217 aa, MYCOBACTERIUM LEPRAE
  hypothetical: YES
MIVVGNFTQSNYVPASRGRRSSQLSGDDREQAILAVAERLLAERPLGDFSVDELAKGAGISRPTFYFYFPSKNAVLLSLLDDLNMKSRSAVEALAEQLPADPAAVWRSAITAFFEVCGTHRAVAVAGAAAKATSPEVRRLWSTVMQQWIDYNTAAIQAERKCGVAPDTIPAEDLAVALQLMTERVMAATFSDEKPLIPDKKVIDTLVHIWLASIYGS

SEQ ID NO: 68 - protein, 429 aa, MYCOBACTERIUM LEPRAE
  hypothetical: YES
MREPADDQPGGTEPDPTPLHYPAGGIPNLSVTPSEIAAAAERLDQGYGPFAVDTERASGFRYSNRAYLIQIRRANAGTVLIDPVSHGNDPLTALRPVAEVISKDEWILHSADQDLPCLAEVGMRPPALYDTELAGRLAGFDRVNLATMVQRLLGFELAKGHGAADWSKRPLPSDWLNYAALDVELLIELRTAISKVLAEQDKTDWATQEFNYLRTYATRGATTETIPPTRRDRWRRTSGIRRVRDRRALAAVRELWATRDHIAQRRDIAPRRILPDTAIIDAAIADPKTIDELIAMPVFGGANQRRSAAMWLAALETARQSQDLPDEAEPSNVPPPPGRWARRKPDAAARLEAARAALATVSQRVGVPTENLVSPELVRRLCWDWEVLPESSVDPVNAVEEYLRVGQARAWQRELVVTILASAVKSSAG

SEQ ID NO: 69 - protein, 196 aa, MYCOBACTERIUM LEPRAE
  hypothetical: YES
MAPVTAAEPTPFREAVAAMNAFTVRPEIELGPIRPPQRLAPYSYALGAQVKHPELDIVPEQSEDNAFGRLILLYDPDGSDAWDGTIRLVAYIQSDLDSREAIDPLLPEVAWSWLIEALESRIDHVTALGGTVTATTSVRYGDISGPPRAHQLELRASWTATTPEVGVHVKAFCEVLEHAAGLPPAGVIDLGSRSRS

SEQ ID NO: 70 - protein, 451 aa, MYCOBACTERIUM LEPRAE
  hypothetical: YES
MTSRSYCVVGGGISGLTAAYRLRVATGDDVAITLFDPGDRLGGVLRTECVGGQPMDLGAEAFLLRRPEVPALLAELGLSERQRATTDARPLIYSQQRLHSLPPDTVAGIPSSATSVAGLVDDATVARIGAEAVRPLSWEPGSDPAMAELVADRFGEQAVARLVDPLLGGVYAGSAATIGLRAGAPSVAAALDCGATSLMEAVRQGLPPVAAGPVFGALDGGYQVLIDELVRRSRLQWVAATVVGLDRGTCGWTLVDDTGACWSADGVILAVPAPRLVRLLQQIAPRTVAAASRIVSASSAVVALSVPRDTTFPQNSGVLVASGERLRAKAVTLSSRKWGLQGDTQLVRLSFGKFGDQVASTASDDELLAWAVSDLAAVFDVTVDPVDVCVQRWIDAMPQYGPGHADLVAEVRAGLPPTLVVAGSHMDGIGVPACISAAGRAIEALQAEVAR

SEQ ID NO: 71 - protein, 538 aa, MYCOBACTERIUM LEPRAE
  hypothetical: YES
VHPIDPDGGTIFPILPIRRCRMHTRPAISRTHTPQTEPRISHPSSPCSPSGTWLKLNTIAGVPDHLLPLSTVDIDAIDGTKNLRRTRQLRCDGSGVKCSHLARPKVSICIHRPYSEPMARQHPSPRVRELIREGARIALNPTQEWIDQLDRATFAANPAIANDPVLAKVVRRASRAHLVHWATANLRDPGAPVPAHLGPEPLTMARDLVRRGRDVLALDIYRVGQYTAWRRWMEIAFTLTSDPQELREILNVSAQSINEYVAATLEAIATHMQLERDELTRSTHAERLEVVDLILEGAPVTQERAEARLGYRLGLTHTAAVIWSDDLDGDHGYLDQAAEAFSHVVESTQQLIVVASAATRWVWLADALALDVPEVQKALLNLSKARVAIGTSSAGIEGFRRSHLEALTAQRTLARLKSHQQVAFFADVQLVSLITQNPEDAKEFITSTLGDFESASPALQQTLLTFINEQCNASRAAKRLFTHRNTLLRRIESAEKLLPRPLDHTSVHIAVALEALQWRGDQTNTSGPRAGRNDGVPA

SEQ ID NO: 72 - protein, 317 aa, MYCOBACTERIUM LEPRAE
  hypothetical: YES
MTGTAGGVGIGLATLAADGSILDTWFPAPKLTESGTSVTSQLAMSDVPYELAVLTGRDDDRGTETIAVRTVIGSLDEVAADAYDAYLRLHMLSHRLVAPHGLNADGLFGVLTNVVWTSRGPCAIDGFDTVRAQLRRHGPVTIYGVDKFPRMVDYVVPTGVRIANADRVRLGAHLAPGTTVMHEGFVNYNAGTLGASMVEGRISAGVVVGEGSHVGGGASIMGTLSGGGTQVISIGKRCLLGANSGLGISLGDDCIVEAGLYVTTGTKVNTPEGKSVKARALSGGSNLLFRRNSVTGAVEVVARDGRGSTLNEALHTN

SEQ ID NO: 73 - protein, 82 aa, MYCOBACTERIUM LEPRAE
  hypothetical: YES
VLGAHAIIAVSSGMLRIYPTLDPRLVHVIWNAMYSIRPGSGTVRARYRLKLAHCGVRGTDGSPDRKGVAHLATAAHRFSPDV

SEQ ID NO: 74 - protein, 231 aa, MYCOBACTERIUM LEPRAE
  hypothetical: YES
MAKLDYNTLNSTIRYLMFSVFSVRPGVLGAQRDTVIHDVRTFFKHQEKRGVVVRGLYDIAGLRADADFMIWTHAERVEALQATYADFRRTTKLGRACSPVWSSVALHRPAEFNKSHIPAFLAGEEPGAYICVYPFVRSYDWYLLPDQERRHMLAEHGMAACGYKDVRANTVPAFALGDYEWLLAFEAPGLDRIVDLMRELRATEARRHTRAETPFFTGPRVPVEQLVNSLP

SEQ ID NO: 75 - protein, 109 aa, MYCOBACTERIUM LEPRAE
  hypothetical: YES
MVAIMAGTATVQLTAIWLLTAVKVQLLNLARRFTPVPWVVLIAFFAFYLIGSLAGFSQWVFDLEPFTFTHVPWVGGGDFTIVPLLWLLAIDAVLITLVTKAFQRCDLCN

SEQ ID NO: 76 - protein, 99 aa, MYCOBACTERIUM LEPRAE
  hypothetical: YES
VREITSKGGARVFAGCFGGCTDSTPTMLAKTLNRVTELVLLSYAVSSGPSGFKGRQGERCGQLRTEIDMCAGQEVQSRTNCGGVGPKPIPTGPKDAGVL

SEQ ID NO: 77 - protein, 97 aa, MYCOBACTERIUM LEPRAE
  hypothetical: YES
VQLLHLSKDHSTDVITAAMINHKTTPYHRIAVQPQRETKTSKRLSYPHHHGIDTDLCDLTHRPANTLTHHPLLHPHNESALTLTSTQPPVVTTQRAR

SEQ ID NO: 78 - protein, 100 aa, MYCOBACTERIUM LEPRAE
  hypothetical: YES
MTAAHFMTDPQAMRDMARKFDMHAQNVRDESHKMFMSSMDIAGAGWSGTAQLTSHDTMGQINQAFRHIVTLLQDVRDQLGTAADRYEHQEENSRKILSGS

SEQ ID NO: 79 - protein, 95 aa, MYCOBACTERIUM LEPRAE
  hypothetical: YES
MGNINYQFGEIDAHGAAIRAQAAALETTHQAILATVRDAAEFWGGQGSTAHEMFIADLGRNFQMIYEQANSHGQKVQRASSSMADTDRSVSSAWS

SEQ ID NO: 80 - protein, 117 aa, MYCOBACTERIUM LEPRAE
  hypothetical: YES
VQRRTRWISGRYYAEINSAKMYFGLGSGSMLVDVFPAAEEVVEDTVLVLVGDEAAALEQLLGQTADVAGAAKSGPVQPMGDRGSVSPVGQMVRSALRTPTRAFAMPSSPAAGSLHLG

SEQ ID NO: 81 - protein, 400 aa, MYCOBACTERIUM LEPRAE
  hypothetical: YES
VRETRCRGSIRRRPASPARCQPHLQFLSRRSGYLLGLEDVISTLVCVLDLRGDPIELTAALVDIPSESRAEARIADAVETALRAQTAGFEIVRNGNAVLARTSLHRPARVLLAGHLDTVPVAGNLPSRCEKDVLHGCGTVDMKSGDAVFLHLAATVTEPVHDLTLMFYDCEEIDSAANGLVRIERELPEWLAADVAILGEPTGGYIEAGCQGTLRVVINAAGSRAHSARSWLGDNAIHKLGAVLDRLAAYRARTVDIDGCVYREGLSAVRVDGGVAGNVIPDAASVTVNYRFAPDRSVAAALRHVHDVFDGLDVQIEQTDAAVGALPGLSQPAAKALVEAADGQVRAKYGWTDVSRFAALGVPAVNYGPGDPNLAHRHDERVPVVQITAAVDMLRRYLGG

SEQ ID NO: 82 - protein, 344 aa, MYCOBACTERIUM LEPRAE
  hypothetical: YES
VMASKVTRMMHAWRVRRPGPIQTSPLEWVTTEVPCPEPSELLVAVRACGVCRTDLHVAEGDLPVHREHVTPGHEVVGEVLGVGSDVDAAAGFDVGDRVGIAWLRYTCGVCNYCRSGTENLCVQSRYTGWDVDGGYAEFTTVPAAFAHHLPSGYSDCELAPLLCAGIIGYRSLLRSELPPGGRLGIYGFGGSAHIAAQVALVQGAEVHVMTRGARAQELALELGAASAQGVADLPPVPLDAAIVFAPVGDLVLPACEALNRGGTLAIAGIHLSDIPQLNYQRHLFQERQIRSVTSNTRADARAFLDFAAQHHIAVTTPEYPLEQADQALTDLSVGRISGAAVLLA

SEQ ID NO: 83 - protein, 327 aa, MYCOBACTERIUM LEPRAE
  hypothetical: YES
MIDVSGKIRAWGRWLLVGAAATLPSLISLAGGAATASAFSRPGLPVEYLQVPSEAMGRSIKVQFQNGGNGSPAVYLLDGLRAQDDYNGWDINTSAFEWYYQSGLSVVMPVGGQSSFYSDWYSPACGKAGCTTYKWETFLTSELPKWLSANRSVKSTGSAVVGLSMAGSSALILAAYHPDQFIYAGSLSALMDSSQGIEPQLIGLAMGDAGGYKAADMWGPPNDPAWQRNDPILQAGKLVANNTHLWVYCGNGTPSELGGTNVPAEFLENFVHGSNLKFQDAYNGAGGHNAVFNLNADGTHSWEYWGAQLNAMKPDLQNTLMAVPRSG

SEQ ID NO: 84 - protein, 195 aa, MYCOBACTERIUM LEPRAE
  hypothetical: YES
MSLLSIGQQFPAYQLTALIGGDLSKVDAQQPGDYFTTVSSDSHPGKWRVVFFWPKDFTFICPTEIAAFGKLNEEFEGRGAQILGVSIDSEFVHFQWRAQHEDLKRLPFPMLSDIKRDVSAASGALNADGVADRVTFIVDPDNDIQFVSVTAGSVGRNVEEVLRVLDALQSDQLCACNWRKGDPTLNATELLKTSA

SEQ ID NO: 85 - protein, 159 aa, MYCOBACTERIUM LEPRAE
  hypothetical: YES
MQGDPDVLRLLNEQLTSELTAINQYFLHSKMQENWGFTELAERTRVESFDEMRHAEAITDRILLLDGLPNYQRIGSLRVGQTLREQFEADLAIEYEVMSRLKPGIIMCREKQDSTSAVLLEKIVADEEEHIDYLETQLALMGQLGEELYSAQCVSRPPS

SEQ ID NO: 86 - protein, 97 aa, MYCOBACTERIUM LEPRAE
  hypothetical: YES
VVEDFTVGDHVTVDWLGGHCNHCPPYRKDICICYANIKIPSWHEPGGYAESVTVPANALARIPTKRSFVEATPMGYSGLHHLLRAAQDQSIDRLAGL

SEQ ID NO: 87 - protein, 85 aa, MYCOBACTERIUM LEPRAE
  hypothetical: YES
VRLLRLLILLPLVLPPWLVALRCSNAFGRLGLIGRCLQASDISIAFNKTAVVMAHTFISLSFLGISHGDVARIVGAAYEYECGRL

SEQ ID NO: 88 - protein, 78 aa, MYCOBACTERIUM LEPRAE
  hypothetical: YES
VSPLFAPKAVATLRDRIEQTTLALLDQLAHQHDVVDVVNRYCSQLPVAVISDILGYPIATEATFLSSANWSHPAWTLN

SEQ ID NO: 89 - protein, 320 aa, MYCOBACTERIUM LEPRAE
  hypothetical: YES
MIYHTILIGMSDKSYQPTIAGLRAFVAVVEKGHFSAAASFLGVRQSTLSQALAALESGLGVQLIERSTRRVFVTTQGRHLLPRAQAAIEAMDAFTAAAAGESDPLRGGMRLGLIPTVAPYVLPTMLTGLTHRLPTLTLRVVEDQTEHLLTALREGALDAAMIALPVETAGIAEIPIYDEDFVLALPPGHPLSGKRRVPTTALAQLPLLLLDEGHCLRDQTLDICRKSGVQAELANTRAASLATAVQCVTGGLGVTLLPQSAAPVESVRSKLGLAQFAAPCPGRRIGLAFRSASGRSASYRQIAKIIGELISTEHHVRLVA

SEQ ID NO: 90 - protein, 414 aa, MYCOBACTERIUM LEPRAE
  hypothetical: YES
MAAKRRMPRVHDLAPLIQFKRPKFGATKRRLEAALTIQDLRCIAKQRTPKAAFDYTDGAAEDELSIKRAQQAFRDIEFHPAILRDVTNVCAGWDVLGHSVLLPFGIAPTGFTRLMHTEGEIAGARAAAAAGIPFSLSTLATSAIEDVVAAVPQGRKWFQLYMWRDRDRSMALVERAADAGYDALLVTVDVPVAGARLRDTRNGMSIPPALTLRTVFDALPHPRWWIDLLTTEPLAFASLDRWSGTVSDYLNTMFDPSVTFDDLAWIKTQWPGKFVVKGIQTLDDARAVVERGIDGVVLSNHGGRQLDRAPVPFHLLPTVAREFGKDTEILLDTGIMSGADIVAAIALGARCTLVGRAYLYGLMAGGEAGVRRAIEILESGVIRTMQLLGVTCLEELSPRHVTQLQRLGPIEPPA

SEQ ID NO: 91 - protein, 85 aa, MYCOBACTERIUM LEPRAE; identical to SEQ ID NO: 87
  hypothetical: YES

SEQ ID NO: 92 - protein, 148 aa, MYCOBACTERIUM LEPRAE
  hypothetical: YES
VRKLCKLFVKSAVVSGIVTASMALSTSTGMANAVPREPNWDAVAQCESGRNWRANTGNGFYGGLQFKPTIWARYGGVGNPAGASREQQITVANRVLADQGLDAWPKCGAASDLPITLWSHPAQGVKQIINDIIQMGDTTLAAIALNGL

SEQ ID NO: 93 - protein, 303 aa, MYCOBACTERIUM LEPRAE
  hypothetical: YES
MAATPEFGSLRSDDDHWDIVSSVGYTALLVAGWRALHAVGPQPLVRDEYAKYFITASRDPYLMNLLANPGTSLNETAFPRLYGVQTRFFDDFFSSAGDTGIRQAVIVAAGLDSRAYRLKWPNGATVFEIDLPKVLEFKARVLAEQGAIPNAGRSEVAADLRADWPRALKAAGFDPQRSSAWSVEGLLPYLTNDAQSALFTRIGELCAPGSRIAVGALGSRLDRKQLAALEATHPGVNISGDVDFSALTYEPKTDSAQWLAAHGWAVEPVRNTLELQTSYGMTPPDVDVQMDSFMHSQYITATR

SEQ ID NO: 94 - protein, 53 aa, MYCOBACTERIUM LEPRAE
  hypothetical: YES
VATVSELQLPPVVTDCHLNVEFSVVPGEVLAVLGAKGAGKSTALQVIAGLFAP

SEQ ID NO: 95 - protein, 73 aa, MYCOBACTERIUM LEPRAE
  hypothetical: YES
MLRTVGVQDKALYIYRGKAYIYRGKALGLAAPGEQLSRAPTANHGNCHVVKRSGSLLYAHWLPNRRFYSSTSR

SEQ ID NO: 96 - protein, 287 aa, MYCOBACTERIUM LEPRAE
  hypothetical: YES
MNQVDLDSTHRKGLWAILAIAVVASASAFTMPLPAAANADPAPLPPSTATAAPSPAQEIITPLPGAPVSSEAQPGDPNAPSLDPNAPYPLAVDPNAGRITNAVGGFSFVLPAGWVESEASHLDYGSVLLSKAIEQPPVLGQPTVVATDTRIVLGRLDQKLYASAEADNIKAAVRLGSDMGEFYLPYPGTRINQETIPLHANGIAGSASYYEVKFSDPNKPIGQICTSVVGSPAASTPDVGPSQRWFVVWLGTSNNPVDKGAAKELAESIRSEMAPIPASVSAPAPVG

SEQ ID NO: 97 - protein, 99 aa, MYCOBACTERIUM LEPRAE
  hypothetical: YES
MDVMAATEYLARSTTLTSVGWIGYIIIGGIAGWIAGKIVQGGGSGILMNIVIGVVGALIGGFLLSFFVNTAAGGWWFTLFTSILGSVILLWVVGRVRKT

SEQ ID NO: 98 - protein, 69 aa, MYCOBACTERIUM LEPRAE
  hypothetical: YES
MLPETSVPTPLLCGALRIVFPVHADVIKHAVEQNTQAPAVRFGEQLVEVGVVTEPGIDTCSGRWCRSHL

SEQ ID NO: 99 - protein, 232 aa, MYCOBACTERIUM LEPRAE
  hypothetical: YES
MFAALHRDRGVNLQLQTQVEEITRADGADDKATGVKMRDRSTVAADAVLVAVGTKPNIELVEQARLSIDSDGVCSSTHPLRTNDPDVYAVGYLTSAEHPLFTIRIRTGHWANVLNQPAAAGRRLEVSTPLILCRKFQGCLNLSQWIKTFTQAGKPGAYVRVISSATVRVGDMITIDYPPTPTHSDNKVTVELVLRVITTKVDTHPLMSHLGAAPVPEPGRRHRGCWCRCQRT

SEQ ID NO: 100 - protein, 85 aa, MYCOBACTERIUM LEPRAE
  hypothetical: YES
MSRIASQLGQPEHLTHALIILLTVAGVPSVYAGDEFGFRGLKEERYGVDDAVLPEFFSPPMQLDVFGVHAWALHQYLIGLRRRHP

SEQ ID NO: 101 - protein, 147 aa, MYCOBACTERIUM LEPRAE
  hypothetical: YES
MTVHMAAPADKVWNLIADVRNTGRFSPETFEAEWLDDVTGPALNAKFRGHVRRNEIGPVYWTTCKVTACEPGREFGFTVLLGNKPVNNWHYRLVTSGDGTYVTESFRFNRSPLLTVYWLLGGFLRKRRNIRDMTKTLRRIKDVVEAE

SEQ ID NO: 102 - protein, 139 aa, MYCOBACTERIUM LEPRAE
  hypothetical: YES
VRPVPTGKVKWYDADKGFGFLSQEDGEDVYVRSSALPAGVEGLKAGQRVEFGVASGRRGPQALSLKLIDPPPSFARQVRREALAEHRHSPDELHGMVEDMITLLESTVQPELRKGRYPDRKTARRVSEVVKAVAREFDA

SEQ ID NO: 103 - protein, 384 aa, MYCOBACTERIUM LEPRAE
  hypothetical: YES
MDGEAHPIILHQDGWQLRDYQRLAADSFWSGGSGVVVLPCGAGKTLVGAAAMAKTGATTLILVTNIVVARQWKRELITHTSLTEDEIGEYSGERKEIRPVTISTYQMITHRTKGEYRHLELFNSRDWGLIIYDEVHLLPAPVFRMTADLQSKRRLGLTATLIREDGREGDVFSLIGPKRYDTPWKDLEEQGWIAPAKCVEVRVTLTNNERMTYATAEPEERYRVCSTAHSKIAVVKSVLSRHPGEQTLVIGAYLDQLNELGSELNAPIIQGSTRTKEREALFDAFRRGEVFTLVVSKVANFSIDLPEAAVAVQVSGTFGSRQEEAQRLGRLLRPKADGGGAIFYSVVARDSLDAEYAAHRQRFLAEQGYSYIIRDADDLLGPAI

SEQ ID NO: 104 - protein, 403 aa, MYCOBACTERIUM LEPRAE
  hypothetical: YES
MSEEAFIYEAIRTPRGKQKNGSLHEVKPVSLVVGLVEELRKRNPDLDENLISDVILGCVSPVGDQGGDIARATVLAAGLPVTAGGVQLNRFCASGLEAVNTAAQKVRSGWDDLVLAGGVESMSRVPMGSDGGAMGLDPATNYDVMFVPQGIGADLIATIEGFSRDDVDVYALRSQEKAAAAWSGGYFAKSVVPVRDQNGLLILDHDEHMRPDTSKEGLAKLKPAFEGLAAMGGFDDVALQKYHWVEKINHVHTGGNSSGIVDGAALVMIGSEAVGKSQGLTPRARMVATATSGADPVIMLTGPTPATRKVLDRAGLTVDDIDLFELNEAFASVVLKFQKDLNIPDEKLNVNGGAIAMGHPLGATGAMILGTMVDELERCNARRALVTLCIGAGMGVATIIERV

SEQ ID NO: 105 - protein, 725 aa, MYCOBACTERIUM LEPRAE
  hypothetical: YES
VLPPSSRGFNSMADTAIQWSKDADGIVTLTMNDPSRSANVMNEIYIESMGNAVDRIVAEKDSITGVVITSAKRTFFAGGDLTAMINTGSEEAGQCFDTVETVKKQLRTLETLGKPVVAAINGAALGGGLEIALACHHRIAADVKGSQLGLPEVTLGLLPGGGGVTRTVRMFGIQNAFVNILSQGTRFKPAKAKEIGLVDELLSTVEELVPAAKAWIKANPEAHEQPWDKKSYEMPGGTPTSPGLAAILPSFPSLLRKQLKGAPMPAPRAILAAAVEGAQVDFDTASRIESRYFVSLVTGQVAKNMIQAFFLDLQHINSGGSRPDGIGKTPIKKIGVLGAGMMGAGIAYVSAKAGYNVVLKDVSLEAAQKGKSYSEKLEAKALERGRTTQEKSDVLLACIAPTGDPTDLKGVDFVIEAVFENQELKHKVFQEIEDIVDPNAVLGSNTSTLPITGLATGVKRQEDFIGIHFFSPVDKMPLVEIIKGEKTSDEALARVFDYALAIGKTPIVVNDSRGFFTSRVIGTFVNEALAMLGEGVEPSSIEQAGAQAGYPAPPLQLSDELNLELMHKIAIATRKGVEDAGGMYESHPAETVVEKMIKLGRSGRLKGAGFYEYVDGKRSGLWLGLRETFKSGSSQPPLQDMIDRMLFAEALETQKCLDENVLTSTADANIGSIMGIGFPPWTGGSAQFIAGYSGPAGTGQQAFVSRARELVAKYGDRFLPPESLL

SEQ ID NO: 106 - protein, 569 aa, MYCOBACTERIUM LEPRAE
  hypothetical: YES
VTAPKIEAVYTVGAYLLDRLAELGVTEIFGVPGDYTLEFLDHIVAHPTIRWVGNANELNAGYAADGYGRLRGISALVTTFGVGELSAANAIAGSYAEHVPVVHIVGAPPKDAQSTHRALHHSLGDGDFEHFIRISSEITCSQANLTTATACKEIDRVLSEVRKHKRPGYILLSTDVARFPTEPPAAPLPGHTDGTSPRALSLFIDAATKLIADKRMTVLADLLVHRLQVVKELETLLTADVVPYATLMWGKSLLDESSPNFLGIYAGAASTEAVRAAIEQAPVLVTAGVVFTDMVSGFFSQRIDPARTIDVGQYQSSVADKVFTPLEMGDALEALASILVRRGVSSPPVELPPGNPTADTPSPTQRLTQQILWDRLCAALTPGNVVLADQGTAFYGMVEHRLPRGVTFIGQPLWGSIGYTLPAALGAGLAHRNRRTVLLLGDGAAQLTIQELGSFYREGLSPVIVVVNNDGYTIERAIHGATAPYNNIARWRWTDIPGALGVANHSSFRAETYGELDEAFAVAAELKDQMVFVEVIVPKLDLPSLLTALTRPAQDSNRIFQLPNPGWDN

SEQ ID NO: 107 - protein, 129 aa, MYCOBACTERIUM LEPRAE
  hypothetical: YES
MSRCPLEPGCRNEHHNRTTCRQHARRRTFRCRIPRTSRQAIPPATERNRNRGTHAWWTAPSASRDRNRHHATARPPPTDPRHSLPSVDPTQFRRRSRPPPGHHWRCNQEPTVSPPMSAQADPPGPNPPV

SEQ ID NO: 108 - protein, 109 aa, MYCOBACTERIUM LEPRAE
  hypothetical: YES
MNFGSPLAGAKVIELTGIGPGSHAGMVLADLGANVVRVRRPGGLTMPSEDRDLLHRGKRIVDLDVNTPSGAIALLELAAKADVLPDCFRPAPASDLVSVPASARRLTSD

SEQ ID NO: 109 - protein, 426 aa, MYCOBACTERIUM LEPRAE
  hypothetical: YES
MAVALANTLFFAAASGESKSKVALYLLITIAPFAVIAPLIGPALDRLQHGRRVALATSFVLRTGLATLLIMNYDGATGSYPSMVLYPCALAMMVLSKSFSVLRSAVTPRVMPPSIDLVRVNSRLTVFGLLGGTIAGGAIAAGVEFVCAHLFKLPGALFVVAAITISGALLSMRIPRWVEVTAGEIPATLSYRLHRKPLRQSWPEEVKKVSGRLRQPLGRNIITSLWGNCTIKVMVGFLFLYPAFVAKEHQANGWVQLGMLGLIGTAAAIGNFAGNFTSARLQLGRPAVLVVRCTIAVTVLALAASVAGNLLMTTIATLITSGSSAIAKASLDASLQNDLPEESRASGFGRSESTLQLAWVLGGALGVMVYTDLWVGFTAVSALLILGLAQTVVSFRGDSLIPGLGGNRPVMIEQESMRRAAAVSPQ

SEQ ID NO: 110 - protein, 158 aa, MYCOBACTERIUM LEPRAE
  hypothetical: YES
MLYSADPSTGEQLDTDNVVNQILTLLVSGSQTLANAIAFALHYLLSIHHDIAAQTRREIYQNRSDRGIANVSYCSAMSLNCDAYVVSSTQLCGCGLVVPCYLRQARRDTTLGNGTSLFHKGQWVIVLLTAPMPGGPMLTNSTPTESCRKFAGSCPVYL

SEQ ID NO: 111 - protein, 269 aa, MYCOBACTERIUM LEPRAE
  hypothetical: YES
MTGPVEDSAVATVAEWPEELAAVLTNAADDARAAIEEFSGSVTVGDYLGVGYEDPNAATHRFLAHLPGYQGWQWAVVVAAYPGAEHATVSEVVLVPGPTALLAPEWVPWEQRVRPGDLGPGDLLAPTSEDLRLVPGYNASGDPAVDEIAAEIGLGRRWVMSVWGRSAAAERWHGGDYGPDSPMARSTKRVCRDCGFFLSLVGSLGAMFGVCGNEMSADGHVVDKLYGCGAHSDTPAPAGSGSSVYEPYDDGVLDILEPSTVQLPESPAD

SEQ ID NO: 112 - protein, 266 aa, MYCOBACTERIUM LEPRAE
  hypothetical: YES
MSTWCSKNENTCSWLALTAWSKAQSPFPARLRCSTAPAGRSGGLRNNRSHRRGAIGKTVPELRRRRAVSASGNLGVGHRRRLGDQASEFVARQTRSAVVGADRDWLQIVQQLRHVLPLRRPASARLRRQRGVLLGPAGKGWNGRHLKCRHSAIRQPSTPQNKPTCGITWCTLSSANATTLSIRQSGDSPCLRTDTLLIDPSALMTKFHRTSVAALNTLNSRPRLSRNSGSGADGSMVMAKHTHILSPPTYRRVYATRWPRWYFKVL

SEQ ID NO: 113 - protein, 187 aa, MYCOBACTERIUM LEPRAE
  hypothetical: YES
MTDGPLIVQSDKTVLLEVNHKLADAARAAIAPFAELERAPEHVHTYRITPLALWNARAAGHDAEQVVDTLISHARYAVPQPLLVDIVDTMARYGRLQLVKNPAHGLTLVSLDRTVLEEVLHNKKIAPMVAAASTTTQSSSIPANVAGSNSFCLRSVGPQRISLVTWMVRRTRLSCIRTVGSCAITSG

SEQ ID NO: 114 - protein, 267 aa, MYCOBACTERIUM LEPRAE
  hypothetical: YES
MVPGPLQRNLAKELGTVATVESAGTAMVYRISEQSIRHALDIGKTRDWMHALFTNHSKTPVPQRLTYLINDVARRHGQLRIGMAASFVRCEDPALLTQTVAAAEELQLRALAPTVAVSPAPIAEVLVTLQSAGFAPAAEDSSGSIVDVRPRRARLPTPQHRRPYRPLQRPNLETLNAVIAVLRKVAATPFGGIRVDPTVTMSLLQRATKEKTTLVIGYLDAAGIATQRMVSPIAIRGGQLVAFDPGTGRLRDFVIHRITSVVSSDSQ

SEQ ID NO: 115 - protein, 323 aa, MYCOBACTERIUM LEPRAE
  hypothetical: YES
MLQKLLEGSPLGRTRDAAPGAPPDRPVPQLLAMGLLRRIDADTVILPRRVGQVLRGEQSGPTQLTQPYPVVSVTTPNDADAEAAGAVIEALHELDVLLETLGSAPVYELRNGGLGVREFKRLAKATGINEPRLGLLLEVTAAAGLIASGIPDPEPATGDSPYWAPTVATDRFTAMPPAERWHLLASTWLDLQCRPALIGSRGPDAKSYGALSNSLYSTAAPLDRRLLLGMLAELPAGVGVEAAEASAALIWRRPRWARRLQPGPVADMLAEGHTMGLVGRGAISTPGRALLDEAIASADPAIAVAAMTRHCPNRSTTFSCKPT

SEQ ID NO: 116 - protein, 174 aa, MYCOBACTERIUM LEPRAE
  hypothetical: YES
MSESYRKLTTSSIIVAKITFTGAMLDGSIALAGQASPATDSEWDQVARCESGGNWSINTGNGYLGGLQFSQGTWASHGGGEYAPSAQLATREQQIAVAERVLATQGSGAWPACGHGLSGPSLQEVLPAGMGAPWINGAPAPLAPPPPAEPAPPQPPADNFPPTPGDVPSPLARP

SEQ ID NO: 117 - protein, 162 aa, MYCOBACTERIUM LEPRAE
  hypothetical: YES
MQRRVTVLLPAVVMLLAAAAGFGVWLLVREPDPQRPEISVYSHGHLTRVGPYLHCNMLNLDECQTPQAQGVLSADEHNPVQLSVPETISRAPWRLLRIYEDPTGTTSTLYRPNTRLAVTIPTLDPHRGRLTGIVVQLLTLVVDPAGEVHDVPHTEWLVRLTF

SEQ ID NO: 118 - protein, 247 aa, MYCOBACTERIUM LEPRAE
  hypothetical: YES
MYVATAGPGRAPKSVCFDYQQLSVGQAKRAENGSEGANLVSYGAPRASTVRIVDPETRMENPAGTVGEIWVQGDNVGLGYWRNPQQTEATFRARLVTPSPGTSEGPWLRTGDLGVIFEGELFITGRIKELLVVDGANHYPEDIEATIQEITGGRVVAIAVPDDRTEKLVTIIELMKRGRTDEEEKNRLRTVKREVASAISRSHRLRVADVVMVAPGSIPVTTSGKVRRSASVERYLHHEFSRLDAMA

SEQ ID NO: 119 - protein, 245 aa, MYCOBACTERIUM LEPRAE
  hypothetical: YES
MGLVWRSRTSLVGQLIGLVRLVASFAAQLFYRPSDAVAEEYHKWYYGNLVWTKTTYMGINCWKSVSDMWNYQEILSELQPSLVIEFGTRYGGSAVYFANIMRQIGQPFKVLTVDNSHKALDPRARREPDVLFVESSSTDPAIAEQIQRLKNEYPGKIFAILDSDHSMNHVLAEMKLLRPLLSAGDYLVVEDSNINGHPVLPGFGPGPYEAIEAYEDEFPNDYKHDAERENKFGWTSAPNGFLIRN

SEQ ID NO: 120 - DNA (genomic), 36181 bp, MYCOBACTERIUM LEPRAE; double-stranded, circular
  hypothetical: NO
  anti-sense: NO
gtatcatacacatacgatttaggtgacactatagaatactaggatccagtgtgcggtgctgggtcggggacgtgccgaggattctccgctactgatcggggctgttaagactaacctgggtcacttggaggctgctgcgggcatcgccggcttcatcaagacagtgttggcggtgcagcgtggccagattccaccgaatcagcgttttgaaagcccgaacctgcatattccttttgctgagttgcgtatgaaagttgttgataagcatatggaatggccggatacagggcatctgcggcgcgcggcggtgtcatcgtttggcttcggtgggacgaacgcgcatgttgtcattgagcagggtcctgagctgacaccggtcacagaatgcagttccaacactgcggtgtcgacgttggtggtgacgggtaagacggcgtcgcgggtggcagcgatggcggggatgctggccgattgggttgaggggcccggtgctgaagtggcgttggctgatgtggcccatacattgaatcatcaccggtcgcggcacgccaagttcggcaccgtggttgcccgtgatcggatccaggcagtggctggattgcgggcgttggccgccggcaaacaggcgcccggtgtggtcgggcagcaggatggcacacctgggtcaggaacggtgtttgtgtactcgggacgtggttcgcagtgggcggggatggggcgtcaattgctggccgatgaaccggctttcacggccgcggttgccgagttggaaccggtgtttgttgtccacgccggtttctcgttgcacgatgtgctcgctaatggcaaagaactggttggtatcgagcagatccagctggggttaatcggcatgcaactgacgctgactgagttgtggcgttcctatggggtgcaacctgatttggtgatcgggcattcgctgggtgaggtggccgccgccgtggtggctggggcgcttaccgccgctgaggggctgcgggtgacagccactcggtcgcggctgatggccccgctgtctgggcagggcggtatggcactgctcgaactcgacgcggtcgagacggaggcgttgattgtcgactactcgcaggtgacattggcgatttacaattcgccgcgccaaacggtgattgccgggcccactgaacagatcgatgagttgattgaccgggtgcgcgcgcagaatcggtttgccagtcgggtcaatattgaagtggccccccacaatccggcgatggatgcgctgcagccgcagatgcgttccgagctcgccgatgtggccccacggactccgacgattccgatcctttccaccacctatgctgaccttggctcgtgcccggtgttcgatgcccagcactgggccaccaacatgcgcaacccagtgcatttccagcaggccatcatgaccgctggaactgaccaccgcactttcatcgaaatcagtgcacacccgctgctgacccaagccattactgacaccctgcacggtacccggtgcatcagcattgggaccctgcaacgcgatgccgacgacaccgtcacctttcacaccaacctcaacaacgtccacaccgtccacccaccacacacccctcatcctgcggaaccacacgtaactatccccagcactccctggcagcacacccgccactggatccctcggaaacgttcggtcaactctattggattggcaccccaggtgggcacgctacttggccaacacaccgcggtctcagggattcttcctatccacttgtggcaggcgcggctaggccgcaggccaagccgtacaggggttggcatcgagtccacggtgtcgaggtggtccctgcttctattgtgctgcgcacaatcctttgtgctgcagcagaattgggttattctacgctattcgagatccgattcgagcaacccattttcgctaatctcccccgtttgatccaagtcgtcgtcgataaccaattgatcagcctggcctcaagtccggccaccgaaactcctcagcaccggtggacgcggcatgtgaccgcgcagctttcctcagcatcggcgcgttccgcggttccatcggaccacccggatcagattaatggtcatcttgaggtgatttcggacccgattcccgacgtagcttcgctgctcgcgctgtgtggggttgacggcctgcctttcgagtggtccgtcaagtcatgggcgaaaaagacgcagcagtcaaccagccgcacggttgagatcgaatttcccgataccctgcccgacggggcgatcgcgccgctactcgacgccgcaattcttatcccagcgctggcggacgttaccgaaacgcaattttacgtgccggcaagcattaagcaggtgtggttaggcgacaccgctacaggaccatgtggtgcggtgacgctaaatcgcactgcttgcgacgacgacgggattaccgtcgatgtcaccgtcgccgacggcagcggtgtgccgttggcgttgatgcggtcacttcggtatcgagcgttagaccttgacaacgcgcaacaggactattcgactgttttcgttgaatcccatgtggatgcccttacagatgccaggaatttcgtgcatgcgatcgattggcaaccgcggaccgacctggattgctccaacaccccggtagccagttcggggtctgtcgcggtaatcggtgatgctcgcgctgggtttggcttgctgctcaaggaggcgggctatacgttggctgcgcctgctgatggggtgtctgaggtacgttacgttgtttatgtcgcggatccccacccggcaaccactgccgagaccgacgtcgactttgccgtgcgaatcactgctgagatcagcgatttggtgagggctttggcgaagcgggagccgggcaagcctgtagcactgtggatcgtcacacgcggagtttacgaatcggtggcctcgtccgcgttacgccagagcttcctgtggggttttgggggcgtcatcgccgcggagcatcctgagatgtggggtggactcgtcgatcttgcggctagtgctcttggagccgatcgcgacgacattctcgaccaatttgggccgacgcttgccagtctgcttcaaacaccgaccaggtcgatcgtggtattacgtgacggcgtcgtgcttgccccgacattggtgccgatccgaagtgagccggtgcgcaaatctttgcaatgcaagtccgatggggcctacctcatcaccggcggaatgggtgcacttggtctgctgatggctgattggctcgctgaccgcggcgctcgtcgactggtgttgatgggccgtacaccgttaccgccaaggcgggactgggaactcgacactctcgatgccggactgcgtcagaagatcgatgctatttgcgcccttgagatgcggggagtgacagtcgaagccgtcgcggttgacgtcggacaccacgacgatgtgcaggccttgttggccaagcgtgaccgtgacggcgccgcgccgatccgggggatcattcatgcggcaggcgttacgaatgaccaactagtgacgaacatgaccgacgatccggttcgtcaagttatgtggcctaagatcgccggctgccaggtgctgcacgaggcctttccacctggcagtgtggactttttctacttgacctcctcggccgcaggaatattcggcatcccgggtcagggctcttacgctgccgccaattcctacctggacgcgttggcgcgtacgcgtcgccagcagggctgccacactatgagcatcgactgggtagcctggcgcgggctcggattcgccgctaacgcgcagattgtcagtgatgagttgcagcgaatggggtcgcgtgatatcacgccttcggaagcgttcaccgcgtgggagtacgtcgatgcctacgacgttgcacaggcggttgtattgccggtccctaggtcctacgggtccgccggatcgactgccggggatagctatctagtcccggcacgaaattggtcgcagatggaggccgccgaggtacggaaggagcttgaaagtggcttacggaccatcatcgccgcagagctccgggtggccgaggcggagctggatacagatcgaccattcgccgaacttggactcaactcccttatggcaatggcgattcggcgtgaagccgagcaattcattggtatagagctgtcggcaatcatgctgttcaaccatccaaccgttgcgttactagccgcgtatctgacaaaagttgtcgcaccgcagcacgattcgcaaggagacgagatggccgccttatccgcctcggcaggaggcgtattagatagtctcttcgaccgcatcgaatcgacatcgactgaggccgaagggttggtgtaaatgcggaccgctttcagccggatttccggcatgaccacgcagcagcgcgcggctcttatcgaagaattcaccaagctctctcggattgctgtggcagagcccatcgcggtagtggggatcggttgccggtttcctggggacgtgaccgggccggatagcttctgggatctgctgatcgacggccgcaacgcgatctcgagagtgccggctgatcgttgggacgcggatgcgttttatgaccccgacccgttgacgccgggtcggatgaccacgaaatggggcggtttcgtctccgatatcgcgggtttcgacgcggcattcttcggtatcacgccacgcgaagctgcagcgatggacccgcagcagcggatactactcgaggttgcctgggaagctctcgaaaatgctggaattccaccggattccctgggtaatagccgaaccggcgtgatgattggcgtctacttcaacgaataccaatccatgttggcctccagtctggagaatgtagacgcctacagcggaaccggaaacgctcacagcatcactgtaggccgaatctcctacctgttggggctgcgtggtccatcggtggcggttgatacagcgtgctcgtcgtcgctggtggcggtgcacctagcttgccaaagtttgcggctacgcgaaactgacctggtcctcgccggcggagtgagcatcacgctgcgcccggagacgcaaatcgcaatttctgcatggggattgttgtctccgcacggcaggtgtgcggcgttcgatgctgcggcggacgggtttgtgcgcggtgaaggtgctggcgtagtggtgcttaaacggttgaccgatgcggttcgtgacggagatctggtgttggcggtggtgcgcggttctgctgtcaatcaggatggccgctccaacggcgttaccgctccgaatacggcggcgcagtgtgatgtgatcaccgatgccttgcgctctagtgacgttgcgcccgaaagcgtgaactacgtcgaatcccatggcaccggtaccgtcctgggtgacccaatcgaattcgaggcgctggcggccacgtatggccgcggtgagagcgcatgtgcgctgggggctgttaagactaacctgggtcacttggaggctgctgcgggcatcgccggcttcatcaagacagtgttggcggtgcagcgtggccagattccaccgaatctgcatttttcgcaatggaatccggctatcgacgctgcatcgactagattcttcgtccccactgagaactcctcgtggccgatctcggacggtcaagcagggccgcggcgcgcggcggtgtcatcgtttggcctcggtgggacgaacgcgcatgttgtcattgagcagggtcctgagctgacaccggtcacagaatgcagttccaacactgcggtgtcgacgttggtggtgacgggtaagacggcgtcgcgggtggcagcgatggcggggatgctggccgattgggttgaggggcccggtgctgaagtggcgttggctgatgtggcccatacattgaatcatcaccggtcgcggcacgccaagttcggcaccgtggttgcccgtgatcggatccaggcagtggctggattgcgggcgttggccgccggcaaacaggcgcccggtgtggtcgggcagcaggatggcacacctgggtcaggaacggtgtttgtgtactcgggacgtggttcgcagtgggcggggatggggcgtcaattgctggccgatgaaccggctttcacggccgcggttgccgagttggaaccggtgtttgttgtccacgccggtttctcgttgcacgatgtgctcgctaatggcaaagaactggttggtatcgagcagatccagctggggttaatcggcatgcaactgacgctgactgagttgtggcgttcctatggggtgcaacctgatttggtgatcgggcattcgctgggtgaggtggccgccgccgtggtggctggggcgcttaccgccgctgaggggctgcgggtgacagccactcggtcgcggctgatggccccgctgtctgggcagggcggtatggcactgctcgaactcgacgcggtcgagacggaggcgttgattgtcgactactcgcaggtgacattggcgatttacaattcgccgcgccaaacggtgattgccgggcccactgaacagatcgatgagttgattgaccgggtgcgcgcgcagaatcggtttgccagtcgggtcaatattgaagtggccccccacaatccggcgatggatgcgctgcagccgcagatgcgttccgagctcgccgatgtggccccacggactccgacgattccgatcctttccaccacctatgctgaccttggctcgtgcccggtgttcgatgcccagcactgggccaccaacatgcgcaacccagtgcatttccagcaggccatcatgaccgctggaactgaccaccgcactttcatcgaaatcagtgcacacccgctgctgacccaagccattactgacaccctgcacggtacccggtgcatcagcattgggaccctgcaacgcgatgccgacgacaccgtcacctttcacaccaacctcaacaacgtccacaccgtccacccaccacacacccctcatcctgcggaaccacacgtaactatccccagcactccctggcagcacacccgccactggatcaccacaccgctggcaagcacgaccgcgctgcaacatctcgaccgcaacagggttacgacgcacgctaccggaattggaaacacggaactcgatgactggatctaccagcttgactggccgactcggcccctgacaagtgagcctggtgcgacgtgggccagcagcggctcgtggctggtggtgtccgatgccggactgtcggatgaactggctcggttggtggtattggccgatcctgcatcccgggttgagtacctcgcaccttcggcgcttgatcatgatgtgagcacgctgcatgacctgcataacgctttacggggtgtcgataacgtactctatgcaccatcggtctcgaccgaatctgtcgaccctgtcgatccggagtccgggtaccggctgttccatgcggtgcgacggttggcggccgcgatggttgcgggtacttcgaaaccgaaactcgtcgtcgtgactcgcaatgctcaacccgttgcagtgggtgagcgcgccaaccccgcccacgcggtgttgtggggctttggccgaacattggcgctggaacatcccgaaatttggggtagtgtcatcgatctcgatgcgtcgatgcctcccgagttggctgcccggtgcatattggacgaagtcgctagccaggacgaaaaagaccgagaggaccaggtcgtctaccgagcgtgtctacgtcgcgcaccacggctgcaaaggcgaactgcatccgcggtgtcgtcggtgaagttgagttcggggcaagataccactcagctcgtcatcggggccaccggaaatatcggaccgcatctgatccgtcagctcgccgcgatgggggccacgacgatcgtcgccgtgtctcgcaatcccagcacccggctgttagagctggataagaacctcgccgcaaccgggacgaacctcatctcggttgcggcggatgcgaccgaccctaccgcgatgactgcgttgttcgatcgttttggagtggatctgcctccgctagagggaatctacttagcggcttttgctggccgtccggtcttgctgagcgacatgactgataacgacgtggtcgcgatgttccgacccaaactggacgtcgcatcgctgttgcaccgtttgtcgctgaaacagcctgtaaaatactttcttttgttctcctcgatctcaggtcttatcggttcacgatggctggcgcattacaccgcgaccagtgctttcctggacattctgggctacgcccggcggctggtaggattgcctgccactgtcgtggcctggggcttgtggaaatcgctggccgacgcgcagcaagacgcgacccaggtaagcgctgaatccggcctgcaacccatgactgacgacgtagcgatcggggcattgccgttggtgatgagcccggacgcgccagtgcattcggttgtggcggcagcggattggccgctactggccgctgcataccagacccgcggggtgctgcgcatggtcgatgacctgctgcccgcaccgggcgaggtactgatgcaggaaagtgaattccgcaaagccctacggacttgccaggcagaacgccgacataacatgttgttcgaccacgttagtgctctggtcgccaaggcgatgggacttgcttcccgctgaaacactcgacccgtcggctggcttcttccaactaggcatggactcgctgatgagcgtgacgttgcagagagccttgtcggacagccttggcgagtttctgccggcgtctgtcgtttttgactacccgaccgtgtacagtcttaccgattatctggccactatactgcctgaatttctggaaccagaagcaccatctgggcggacaacggccgacgcatatgacgaattcactgaatccgagttgttggatcaactttcggaaagactaagaggaacgcaatgaccgcctcgacacctgatcgccgggcgatcatcaccgaggcgttgcacaagatcgatgatctcactgcacgcctggaaatcgccgaaaagtccagcactgagccgatcgcagtgatcggcatggggtgccgattcccgggcggggtcaacaaccccgaacagttctgggatctgttgtgcgatggccgaagcggcatcgttcgggttccttccgaccgatgggatgccgatgcctactatacggacgatcacaccgtgccgggcacgatatgcagcaccgaaggcggttttctcaccggctggcagcctgatgagttcgatgcggagttcttctcaatttccccgcgcgaagcatcggcaatggacccgcagcagcggttgttgattgaggtcgcttgggaagcgttggaagacgcgggtgtcgcgccgcacaccattcgtgggactcaaacctcggtattcgtcggtgttaccgcttacgattatatgctcacgttggcgggccggttgcgtcccgaagatctcgacgcctacataccaaccggaaattcggcgaactttgctgctggacggttggcctatatcctcggggttcgtggaccggccgtggtcatcgacacggcttgctcgtcgtcgttggtggcggtgcacctggcgtgtcagagcttgcgtcaccgagaaagcgacgcggctttggtgggtggaaccaatttgttgcttagcccgggaccgagcattgcatgctcgcgttgggggatgctatctccggcggggcaatgcaaggccttcgatgtgtccgccgacgggtatgtgcgtggcgagggtgccggggtggtggtgcttaagcggttggatgacgcggtgcgcgacggcaaccgtatcctcgccatagtgcgtggctcggcggtcaaccaggacggcgccagcagcggagtgaccgttcccaacgggccggcgcagcaggagttgttgcgcaccgcgttagcgtcgtcgaagttgacggctgctgacattgactacatcgaggcccatggaacgggaacgccgttgggtgatccgatcgaactcgactcgctgagcaaggttttcagcgatcggcagagccggcggggctctgtcccgttggtgattgggtcggtgaagactaacctcggccatctggaagcggcagctgggatcgctgggttcatcaaggcggtgctggctgtgcaacgtggtttcattccgcggcacctcaacttccaccagttgacaacacatgccagtgaggctgcatcgcggctaaacattgcgtccgaaggcctcgaatggccgactgtcggtcggccgcgccgggcgggggtgtcgtcgttcggcgtcagcgggacgaatgcacatgtggtgctcgagcaagcaccggacccggtagcagtgccagcacctgggccggcgctgcgccttgttcctgcggtgtcgacactggtggtgtcgggtaagacagtgcagcgggtggccgcgacagcatcggtgctggctgattggatggaaggccctggagctgcggtgccgctgactgacgttgcgcacaccctgaaccaccaccgggcccggcacaccaaattcggcactgtggcggccgttgatcggggccaagcggtggcggggttgcgtgcgctggccgcgggtcaatccacctccggtgtggtggccccccgtgacagcgttgttggtccgggcactgtgttcgtctattcgggccgaggatcgcagtgggccggaatgggtcgccaactgatggccgacgagccggcattcgccgaagctattgccaaactagagcacgaatttgttgtacaggcaggtttttcgttgcacgaggtaatcgccaacggcaaggagctcgtaggcatcgaacagatccagctgggactgatgggaatgcagctggcgctgaccgagttgtggcgctcctacggggtagaacccgatgcggtgatcggtcactctatgggcgaagtcgccgccgcggtagtggccggggctctgactcctacccagggtttacgggtcactgcgacccgatcgcggctaatggcgccattgtccggtcagggcacaatggcgttgctcgaactcgacgccgtggccactgaggcgttgatcgccgactatccgcaggtgagcttggggatctatgcttccccgcgccaaactgtgattgccgggccgacggccatgatcgatgctctgattgacaaggtgcgccagcaggacggttttgccacccgagtcaacatcgaggtggcaccgcacaacccagccatggatgcgctgcaacctcagatgcgttcggagctagccgatctcactccgcagcaaccaaccatcccgatcatctctaccacatacgaggacttcggcagcacccctgtcttcgacgtcgagcactgggcgactaacatgcgtaatcctgtgcgttttcagcaggccattactcacgctagtagcggtgtcggcggcgactatcacaccttcattgagatcagcgcacacccactgctcactcattcgatcagtgacattctgtgcagcatcgccggcacagccgaagaaaatgctgtcggtgcgggctatttgagcatcggcaccctacaacgcgatgctcacgacacactcgagttccacaccaacctcaacgctacgcataccagccgccctccccgaactcctcatccgcccgaaccgcacccggtgctgcccatcactccgtggcagcacactcgccattggatcagtgccatgtcggcggcataccacagggcagacactcatcctctgcttggcgttggtgttaccgatcccaccagtggcaccagagtatgggaaagccaattgggccctgatctgctgtggctgggggatcacgttattgacgatctctgcgtattgccgggtgcagcctacgccgaggttgcgttggcggccgcgacggacacctttccaaacgagcgagtcgaaggagatcagccgtggatgatctatgagcttgaccttcatcaggttttgcacgtgaccgaaggcactgttctcgttaccacgctcaccggcgaccagcagcggtgccggattgaaatgcgcactcgcaacggtttttcgggttggaccactcatgccactgccactgttggtcctgccgagtcagtgcaaccgtcagatcgcgaggagcgcaccgcaaccccggtcgatgtggtggatgaactgggccccgaagacttgtatcagcggctgtgcagcgccggtcaacagcatggtccggcgtttcaagggatcgtcgggcttgcggttgaagaatctggtgccgcccgcgctgaggtgcggttgccttcgtcggccagaatgggtttccgcgacttcttgctgcacccggtaatgatggatattgcgttacagacactgggtgctacccggatggcgaccgatttagccggagggccgaccgcccggaaaacattggtcctaccagtacgttttgcgggcgtgcatgtgtacggtgatgtcactcgcggtgtctgtgctgtcgggttgctgaccgcaaccgagggcttggatcggctggttggcgaagttgtcctgactgatctggacgggcaaccgctacttgtcatcgacgaagtccagatgacggtgcttggagccggcagcgacgcaacggaactcaccgatcgcctattcacgttggagtgggaacctacaccgctgtataaggaggtttcgagatcttccgcgcaaggtggcttgttgttgatcggtgacgtcgccgcgggtgacccgctgttgcttgccttacagtcgtcgctgcgcgcccgattgagtgaaaatgggcctccaccagtggattgcgtctcctttagcgacgaagtgaagctgcaggcggcgatcactcgaaccgacatcagctgggatggcatcgtcgtggtgtgtccgccgcgagcgagcgatgagtctttgcccgatgatgctcaactggaactagcgcagacgcgcacacttcagatcgccggcgtggttcaagcagtgacgcaaatgggtgctcgcaagagtccacggctgtggatcgtcacccgaggtgcgcagcagcttaacgcaggcgagtcagtaacgttggcgcagactgagctacgtggaattgtccgagtgctgacgttcgagcattcggaactcaaagcgaccctgcttgacattgaagctgacggcaccgactcacttgacgacctgaccgaggagctgctggccggctcgaaccacgacgaggtcgcctaccgggacggacaacgttatgtcaaccggttggtgccggctcccatcacgccgaaaggcgaacttgccggcgaaactcgtcgcaaggttgtagaactgggtggcttaggtgctgtccagctgcagatcgatcaacccggacgactggacgcattgacggtgcaccaagtcaagcggggcgagccggaaggcgatcaggtcgaggttcgtgtcgtcgctgcgggactcaatttcagcgatgtgctcaaggcgatgggtgtgtacccgggactcgacggtggagcaccggcgatcggtggcgagtgtgtcggctacgtgacagccataggagacgacgttgactctgtcgaggttggtcagcgtgttatcgcctttggccccggcacattcggaacatacgtgggtacgattgccgatctcgtcgtcccaatccccgacaccttatccgatcacgaggcagccacgttcggcgtagcgtacctcaccgcctggcactgcctgtgcgaggttgggcggctgtctcccggtgaacgtgtgctgatccattccgccactggtggtgtcggcatggctgcggtttcgatcgccaagatgctcggtgcccgcatctacacaacggccggttcggatgccaagcgacaaatgctgtccgagctcggtgtcgagtatgtcggtgactcgcgaagtgtggacttcgccgacgagatactcgagctcacgcacggttatggcgtcgatatcattctcaattctcttgcagataaagcgattcagcgcggtgtgcagatacttgctcccggtggaaggttcatcgaaatcggcaagaaagatgtctacgacgatgccaacctgggcttggccgcgctggcaaagagtgcttccttctccgtagtagaccttgatttgaatctgaaactgcatcctgcccggtatcgccaactgctgcaacacatcttggcgcacgtggccgatggtagattgccggtgcttcctgtcactgaattcagtctgcacaacgctgccgatgcatttcggctcatggcctccggcaagcataccggcaagatcgtcatatcaataccgtatgagggcaacattgaagcgatcgcgtccccgccacccgttccattggtcagccaagacggcggttacctggtcgttggcggtatgggcggtcttggcttcgtcttcgcgcgatggctggccgagcaaggagcgggattgattgtcttgaacggacgttcgtcccccagcgatgatgttacggcggccatagcggacttgaccgcagcgggccaccggattgaggtggtcacgggcgacatctctgaacccggtacggcggaccgactggtgcatgcggtccaaagcgcaggcttccggctggccggagtcctgcacagcgccatggttctcgctgacgagatcatgctgaatatgacggattctgcggcgaggcgggtgttcgttcccaaagtcaccggcagctggcggttacatcaggccaccgctgcgttcgaagtcgattggtggttgaccttctcctcggcttcctcgctgctcggtacaccagggcagggtgcgtatgccgccgcgaacgcgtgggtcgacggcctggtagcctatcggcgttcgcttggactacccgccgtcggaatcaactggggcccatgggctgaggtggggcgtgcccaattcttcgctggtctcggtgtttcgctgctcaccgccgagcagggtctggcggcgatgcagacggtgcttgccgctgatcgtgcgcaaactggtgtgttcagcctcgatgcgcggcagtggttccaatctttcccggctgtggcgggttcgtcgttgttcgcaaatttgcgcgacacggcaaccctgaaaagcggggagcggcgcggcgtgggcaagatccgtgcgcaactggacgttctcgacgcagccgagcgcccgggacacctcgcgtcggcgatcgccgacgagatcagagcggtgctacgctcgagcgatccaatcgaccacgaccggccgctggaagcgctgggtcttgattccttgatgggcctggaattgcgaaaccggttggaagccagtctgggcatcacgttgcctgtcgcgctggtatgggcatatccgacaactgctgaccttgcggccgcactatgcgaacgaatggactatgcgttaccggccgaggtgcaggaggcgactgacacaaacgcggaactgtccaaagcggagatggacctgctctctgatctggtcgaagccagcgagctggaagctgcaacgagaggcgagtcatgacgagcttggcagagcgtgcggcgcagctgtcgccgaacgcgcgcgcggcactggcacgcgaacttgtccgtaccgggactgctttcccaaccgacatttcagagccagtcgcggtggtgggcatcggatgtcgtttcccggggaatgtaactggcccggatagtttttggcagctgttggtcgatggcggggacgcgatcagcgaagttccgccagatcggtgggatgcggatgcgttctacgatcccgacccgtcggcgtcagggcggatgacgacgaaatggggcggcttcgttcccgacgttgatgctttcgacgccgagttctttggcatcacacctcgcgaagccgtggcgatggatccgcagcatcggatgctgctcgaggttgcctgggaatcccttgagcacgccggcattgcaccggattcgctgagcggcactcgaactgcggtgatgatgggactttcctcgtgggactacacgatcgtcaacatcgagcgcagagccgatatcgatgcctacctgagcaccggaactccgcattgcgcggcagtaggacggatctcgtatttgttaggattgcgtggtccggcgatggccgtggacactgcgtgctcgtcgtcgctggtggcaatccacctggcttgtcagagcttacggttgcgtgagagtgacgtggcattagccggcggtgtgcagctcatcttgtcgcctttcaccgccatcgcgttgtccaagtggtcggcgttatcaccgaccggacgatgcaatagtttcgatgccaatgcggatggattcgtgcgtggcgaaggttgcggagtagtggtgctaaaacggctagttgacgcgctgcgcgaccaggatcgtgtgctggctgtggttcgtggttcggcgaccaatcaagacggtcggtccaacggcatgaccgcgcctaacgcgctggcgcagcgcgacgttattactaccgccttgcggctcgcggatatcaccccagacagcgttaactatgttgaaacacatggaaccggaacagtgttgggagaccctatcgagttcgaatcgctggctgccacttacggccgcggcgaaagctcctgtgctttggggtcggtcaagaccaacatcggccatctagaggctgccgccggagtggccggattcatcaagacggtgctggcgttgcagcacgcgtacattccgcgtaatgtccactttactcaatggaacccggccatcgacgcatccacgactcggctgtttgtgcccactgagagcgcaccatggccggcaattccgggcccgcgtcgtggagcggtgtcatcgttcgggctcagtgggactaacgcccatgtagtgattgagcaggcgccagacacgactgtacctatatcggcagctgttggtaggcagtatgtttcggctctggtggtgtcgggtaagactgttacgcgggtggcgtcggcagccgcagtgttggctgactggatgtcgggaccgggcgcggcggcaccactcgccgacgtggcgtacacgctgaaccagcaccgggttcggcaccccaagttggcaaccgtgattgcgcgtgatcacgcggatgccgttgcggggttacgggcgctggcggccggacagccacgagtgggagtggtgggttgtgatcagcatgcagctgggcccggtcgagtttttgtgtattcgggtcagggctcgcagtgggccgggatgggtaggcagctgctggtcgatgagccggccttcgccaaggcggtagctgaactggagcccacgttcgttgctcaggtaggtttttcgctggagcatacactcgcctatggcgacgaggtggtaggtatcgaacgcattcagccggtgctggtggggatccagctggcgctcaccgagttgtggcgttcttacggggtgactccggatgctgtgattgggcactcgatgggtgaggtgtccgcggcagtggtagccggcgcgttgacgcccgagcagggcttgcgggtgatcgctacccggtcccggctgatggcgcgtctgtcgggtcagggcgcgatggcattgctagagttggacgccgacgccgccgaggctctgattgctgactaccctgaggtgacgttggcagtgtacgcttcgccacgccaatcggtgattgccggcttgccggagtcggtggatgcggtgatatcggtggtggcggagcagaatcggttagcgcgccgcgtcgatgtcgaggtggcttcgcaccattcgatcatagatccgattctgcccgagttgcgaaatgcgctagcggatttggttccgcagacgccgatcatcccgataatcaccaccactcacgaacacacccaggcggtgatggacgccgactattgggcggctaacctgcgcaacccggtgcgattccaccaggccatcgcacaggctgttagcggcgtcggtggattcaatcgtacctgccactctttcatcgagatcagcccccaccccgtgctcacacacgctatcactgacaccgtcggcgggtccggaggccatgttgtcacgtcggcgatgaaccgcgacctcgaccagaccctgttcttccacgcccaacttgccaccgtcggggtgaccgagtcggatagcgccaagggtcgattggtggacctgccacccacgccgtggcaacattcgcgattctgggttgcggatcgatcagcgatgtcggagctggccgtggcccacccgttgctcggtgtgcatgtcgaaatgcccggcagtggagaccacggctggcaggcagatgtcggaaccgacgtatgtccctggctagctgaccataaggtattcggccagcctattatgccggctgctgcgtttgctgagatcgctgtggcggcggccgacgaagcgctcggtgtacccgctggcacttctggggccaatattgtaatccaccagttcgaggtcgagcaaatgctttccctcgacaaccacacaccgctcacgacgcagttgacctatcacgggaacagcaaaattcgggtcgagatctattctcgctcacctcgcggtgatttctctcggcacgccacggccaatgttgagcatgtatcgcacaatgccgtgcagccgttccagcaagcacccggttcttcgaacggggtaaccgtgtctccagccgatttctacgctgtgctacggcagactggtcaacaccatggcccggtgtttgctgtcttgacccggataactcggctgcttgacggttccgcggaaaccgagatcactcttcccgacgaggttccccggcatcccggatatcgactccatcccgttgtactagatgcggcattgcaaagcgtcggtgccgcaatacctgacggtgaggtcgctgagtcggcggaagtcagctacctgccggtgtcgttcgaggcgatccgagtgtaccgcgacatcggtcggcacgccctgtgtcgggcacgtttgaccaacctcgacgggggtaccggcaagttgggcaagatcgtcttgattgacgacgctggttacgtagcagccgaagtggatggcatttacttgcgacgtattgaacgccgtgtggtgccattaccgttggcgcagaagatcttcgacgctgagtggatcgaaagcccgatcccggcttcgcgagctttggagcagattaccgagacagcgcgcgcaagttggttggtacttaccgactgggatccttcgatcaaatccctgacagacgaattcattgcgagatggcgctcaccaatgcgacgggtgtacactgcaaatctccacgacgaatcggcgatgcttgccgcattcgcagagacggcgggtgatccagagcacccacctattggcgtggtcatcttcgtcggcggtgcggcaaccgggctggacgatgggctggtgcaagcgcgagactcggtgtggtcgatctcgactgtcgttcgtgcgatcgtaagtacgtggcatggccgatcgccacggctgtggttgatcgccggtggtggtctttccgttcaggatgacgagctgggggctcccgcgacggctgctttgaagggcctggtgcgagtgctggccctggagaatccggacctgcgcgccaccctgctcgatctggatgccacgcaagatcagatcgcagcactgactgcagaattgcacaattctgcgagcgagttcggtggcgatgatgtgatcgcgtggcggggtcaacacagattcgtcgaacggctgtgtaaggccacattggatgctggcaaagacaatcctgtggttcgccccggagcggcatacatcgtgacgggtggtcttggtggccttggcttagtcgttgccagatggttggtagatcgcggtgccggccgggtggtcctgggcagccgcagcgaccccaccgaggagcagcgcaaaactctggtcgaattggaagctcgtgccgaaattgtgtttttgcgcggcgatgtgacgtcgccaggtgtggccgagagtctggtcgcggcggcaggacgagcgggcggccagttgcgcggcatcgtgcacggtgcggcggtcatcgaagacagtctggtgttcaccatgaccagagaaaacttggagcgagtttgggcgcctaaggccactggcgcgctgcggatgcaccaggccagcgttagctgcgagctcgactggtggttggggttttcctctgttgcttcgctcttgggctcgcccggacaagcggcatatgcatgtgccagtgcatggctcgacgctctggtcatgtggcgcaaggcatccggtttgccatcggcggtgatcaactggggtccgtggtcagatgtgggtgtcgcccaggctttggtaggcagtgttctagatacaatcactccggcagagggcatcgaggctatcgactcgttgctggctgccggtcggactcgcacgggcgttgcccggttacgtgccgataaggctctggtcgcattcccggagatgcgtagcatcagctacttcacctgggtggtcgagcagctggccgcggcgggtgacctgggtgactgggtcgggtccgacacgcttgccgatctcgatccggcagaggcccagcgcgtggtgaccgagcggatgtgcgcgcttatcgcggcggttatgggttacgctgaccgatcaacagttaatcctgctgtgccgttgaccgagctggggctggactccctgatggcggtgcggatccgtaacggtgcacgggcggacttcggcgtggagccgccggtgacattgattttgcagggcgcgtccctgcaagacttgaccgccgatgttgtgcgtcaacttgggctcgcgggcccaaagcaggcgctcgagaacgctgacaccgttcgcgaccgcgtttcagcagcgtgcggcggtgcgacgtggagccgtgatgcggcgccgacctaaacctgacgtacagggaggatagaaaccagtgattacccccgacaacgcgatcgcggtggtcggcatggccggcaaatttccgggcgccaacgatgtgtcggcgttctggaccaaccttcggcgcggcaaggagtcgatcgtcaccctgtctgagcaagagctgcgcgacaacggggtcagcgacaaagcactggccgatccggcgtatgtgcgtcgcgcaccgttactcgacgggatcgacgagtttgatgctgacttcttcggtctgccgccgctggccgcgcaggtattggatccacaacaccggttgttccttcagtgcgcgtggcatgcgctagaggatgcaggttgtgaccccgcgcagttcgacggctcgatcggagtatacggaaccagttctcccagcggttatctcttgcataacctgttgtcgcatcgcgacccccacaccgttttggctgagggactcaacttcgaccagttcagtctgttcctacagaacgacaaagacttcttggcaactcggatatcgcacgcgttcaacttgcgcggcccgagtattgcggttcaaaccgcgtgctcgtcgtcgctcgtcgcgctgcatctggcctgcctgagtctgctgtccggcgaatgcgacatggcactggccggcggatcgtcgttgtgcattccgcaccgtgtcggttactggcactccccgggatcgatggtctcggctgttggccactgtcggcccttcgacgtgcgggccgacggtactgtcttcggcagtggtgttgcgttagtggccctcaagccgttgcaggccgccatcgacgccagcgaccgaattcatgccgtcatcctcgggtcagcgatcaacaacgatggatccatgaaaatgggttacgcggcgcccaatcctgccgctcaagccgatgtcatcgcggaagctcatgcggtggccggtattgattcgtcgactgtgagctatgtcgagacccatggaaccggtaccccgctcggggaccccatcgaaatccaagggttgaaaacggcattcgaagtgtcgcagataccccgcccgggcccatgtgtactggggtcggtcaaatcgaacatcggccacttagaagttgccgccggaatcgcgggtctgatcaaaacgattttgtgcctgaagaacaaggcgattcccgcgacgttgcactacaccagtccgaatcgggagctgcgtctggaccaaactccgttcgtcgtgcaaagcaattacggcccatggaagtgggacggcgtgcgtcgggcaggggtcagctcgttcggggtcggtggtaccaacgtccacgtcgtcttggaagaagcatcagttgaagcatccactgttgctgcgtcgaccggtccccaggtgatccttctgtcagcgcaaaccgctgcggcgcttggtgaatcgcgggaagctctggccacggtgttagaaaaaccaggcgcaccggacctgtccgacgtcgcttatacgttggccgggcgccgaaagcacaacatcacgatggctgccgtcgtccgtgaccgggagcatgcggtcacggttctgcgggcggccgagcacgacaatgttttcgttggcgaatccggtgctgataccgggcgcagtgccgccgcctcaatcaccaccttggggtcagatcgcgtcgttttcctgtttcccgggcaaggtgctcagcacgttggaatggccaaaggactctacgacacagagtccgtcttcgctgaacacttcgacacctgttctgccggattccgcgaagcgatggatgacctggatttgcattcggcgatattcaatggtaccgcaatcgatctggagcgcatcgaccgttcgcaaccggcgctgttcacggtggaatacgcactggcgaagttggtcgaaagctttggcgtaggtgccggggcctacatcggatacagcactggcgagtatatcgcagccaccttggccggggtattcgacctcgagacggcgatcaaaacggtgtcgttgcgtgcccgtttgatgcatgagtcgccgccgggagccatggttgcggtggcgctgggccccgaggacatcaccgagtacttagcagagtattctgctaagggcgtcgagttgtccgccgttaacgatcccggtaactgcgtggtcgccgggcccaaagaccagattcgcgcgttcagccaacgtcttgacgaggtggggatacccgtacgtcgggtccgtgccactcatgcgttccatacaagctcgatggagcctatgctgagagaattctccgaattcctttctcgtcaacagcttcgcgttccgaacacaccgttgctgagcaacctcaccggaacctggatgtccgagcagcaggtcaccgatccggaaaactggacacgtcaaatcagttccacgatccgcttcgccgacgagctagacgtggtgctgtcgcaatccgggcgagtccttgtcgaagttggtcccggtggcagcttgaccggttcggcgatgcgtcacccgaggtggtcgagtgggcaccgcgctgttcggctcatgcgccatccgcttcagaacgttgatgaccacgacacgttcctgcgcgcactgggtgaactctggtcggctggaatcgaagttgactgggcgccgcagcgttcggtcatgccgcacctcgtttccttgcccggatatccgtttgctcgacaacgtcattgggtcgaaccccgatatacgatctgggcgcagattcccggcgcgagcagtggttcgccggttgactccagcgtcgattccgccaccgttgaaggggtgcgaggcggggagtcgcagactgaggccacgttgcagcgcatctggtcacagtgcttaggtgtcagttcagtagatcggaatgccaatttctttgatctaggcggcgactccttgatggcgatcagcatctcgatggccgcggccaacgagggtatgaccatcacaccgcaggatatgtacgagcacccgactctggcctcgttgacggctgccgtcgatgcctcattcgcgtcgagtgggttggcgaaaccaccggaggccgcggcgcatccggcggttccacccaacattgcttacttcctcgagcgggggttgtgcgacactggccgctggcgcgttccattgatcctgcggcttgaccccaagatagggtcagacgacattcgagccgtgctgaccgcagtggtcaatcaccacgacgtcttgcgcctcagcctcgtcgacaacgacggaatgtgggaacagcacatcgcggcgaccggagaattcactcggctcttgacccagacgcttcccgacggtgtagccgccggcagtgcagaggaacgggccgtggtatccagtattctggccgaactcattgctagtcaaagtgatttgaacgagccactgaccgccgtgcagatcacaaccgctcacggtggtccgcactatctcggtcttgccgtgcaccagatggttatcgacgatgcatcgcgccaaatcttggggaccgatatcatcaccgcgtttgggcagcggctggccggcgaggagatcacgctggaaccggtcaccactgggtggcgggaatggtcactgcgctgcgcggcccttgcgacgcatccggcagccctcgacactcgctctttttggatcgagaatgcgaacaaggtgaacttgtggttggctgatgtctcgctcaatacagatgttattcaaccgcccggtgccgacgatctgattaggatgccgtgcacgctaagcgttgagcagacgtccgagctggatgatgcccggcgtaggtttcgccgatcgattcaggcgatcgtgctggccgcgcttggtcgcacaattgcccaaacggtcggtgatggtgtggtcgccgtagagcttgagggcgagggccgttcggtgttgcggccggacgtcgacgtgcgcagaacaatcggttggttcacgaactattacccaattccgctggtctgcgtgaagggccagggcgcgcttgcgcaactagacgctgttcataacacccttaaatccattccgcattacggaattggatacggattgctgcggtatatgtacgcgccgaccggacgtgtattcagtgcgcagcgcacgcctgacattcactttcggtacgtgggcgttgtccctgagccgccatccgtcgatgctacggtacagttcgactcggacatgacgattccggtgcaagaaccggttcctgggatgggccacgccatcgaacttcggacgtatcggtttggtggttcactgcatctagattggtggtacgacatccggcggattccgcaggtaacagcagaagcactcgcgcagtccttcccggtcacgcttagcaagttgatccaggaaggcatagctacgcaaaaggatgcgcacgacgagagtgaaatggctggggcaccccaagcgggcgttctggtggacctgtcaaccctggatgccggctgaggaggatcggatgcgcaacaacgacaaggccgtgatggttcgcggggttcgtaagacctacggcaagggcaagattatcgccctggatgatgttagtttcgacgtggatcgcggtgaagtgatcggtctgctcggcccgaacggtgccggcaagacgaccatggtggacatcttgtcgacgttgacccggccggatcgtggcttggctaccgtcgccggctacgacgtggtttccgaaccggccggggtgcgtcgctcgatcatggtcaccggacagcaagtagctgtcgatgaccagctttccggtgagcagaacctaattttattcggtcgtctgtatgggctgagcaaatctgtggcgcgcgtgcggacgcaagaactgctcgagcaatttgacctcctgcacgccgggaagcggcgggtgggcacgtactcgggcgggatgcgtcggcggatagatatcgcgtgcggattggtggttcaaccccaagtggcattcttggatgagcccacaaccgggttggatccgcggagtcggcaagctatttgggatctagtggccagtttcaaacagatcggtattgccacactgctgactacgcagtatctcgaggaggcggatgagctcagtgatcggatcatcttgatcgaccacggtacggtcattgcagaaggcaccgcgagtgagctcaagcaccgtgttggtgagactttttgtgaaatagtaccgcgcgatttgaaggatctgggcactgtcgtcgcagcgctgggttcgctgttgcccgagcgcagcagggcgatgctcacgcccacgtcagaccggattacgatgccggcgccggatggcacgcagacgcttatcgaggctgcacgtcggatcgacgaggtgagtgttgagctggctgacattgcgctacgccggccgtcgctcgatgacgtattcctttcgatgacaacggatcccagtgagtcgctgagccatctagcggcgggggcgatgcgatgagcatgccggcactagctccgattccggcctcgaggtggccaagcacaatcatggcaaagccacgtcggtcgacgctccggcagtggtgggcgctcactacgcgctattatacggacatcaagttgtttgtgtttgagaaaacaatccaaattggcgcaccagtggtattcacggtgggcctctatctaccgtttgccataccgtggaatcattttgtgggtggccctagctcaggcatcgccagtaacttagggcaatacgtcactccgttgatcgtgctgcagtctatcgcattcgccgcgatcggatcagccttccgggcagcaaccgattctctgagaggcataagtcgacggtttcgtactatgccgatcgctccggtgacgccggtgctcgcccgtgtgacggatgccgtgcagcgatgctgttggggtatgggggtagcgctgatttgtggacacgtgatcggattccagttccatcgcggtcccctctatatcgttggattttgtgcattggtgctcgcaatcggagccgcgctgtcattcgccgctgacctgcttggcactgcgatcaggaatcccgacgcgatgctgccgctactgactttgccgatcttgatcttcggactgttgtcggtcggtctcatgccagtcaaactgtttcctcgctggattcacccttttgtccttaaccaaccagtctcccagttcgtggtggcgttacgcgcactggccggggagaccactaagacagtcataccagtggcgtggtctgttatggttccgacgttggcgtggctgttcggtttcctggtggttctggtgcccatatgcctcgtcattttgtttagacggacatgatcactatgataagtcaaacagtaggactggtacccgcgagcttgcagtacccgaacaattctgttcgggcgctcgtttcgcagactttgttgcagaccaagcggttactcactcggtgggcgcgcgattatgtcaccatcattggtgcgctcgtgttgccgattttgtttctggtggtgttgaacatcgtgctgggtaatctggcttacgttgtaacttacgacagcgggctatacagctttgtgccactaatcacccttggcgccgcgatcactggttcaacattcgtcgctatcgaccttgtgcgcgagcgttccatcggtctgctttcccgactatgggtgttgcccattcatcgggcatcgggtttgcttgctcgaatcctcgcaaacacaattcggactttcgtcaccacccttgtgatgctggttactggggtgatactcggtttccggtttcggcaaggtgtgattgcaagccttatgtgggttagtgtcccggtgatatttggtattgccatcgccgttatggtgactaccgtggcgctttacacagagcaaacattcgtggttgaagcggttgagttggtgcaagcaatcgcggtctttttgtccaccggtctggtaccactaaaccagtatccaggatggattcagcctttagtcgctcatcaaccggtgagctacgcattgcggcgatgcgcggattatcgatgggggggccagtcttagcttcgatggttgctatgctggtgtggaccgcaggcatttgtgcctcctgtgcggtacccctgggagtcggctatcgacgggcgtgtacgcattgacgcaatatgtggtggccccgcatgtggtgaccagttgggagtcttgaggtgttcgccggatccgtgatccgaaagctgtcgcacagtgaggaagttttcgcgcgatacgaagttttcacttctatgacgatccagttgcgcggtgttctagatattgatgcgctgtcggaggccttcgacgcgctcgtgcaggctcatccagttttggccagtcatcttgagacaagctccgatggcggttggaacctcgttgccgacgacctgctccaccctgggatctgtgttgttgacgctaacaacggggcgcagtcgggttgtggtggaatacagtccgaaacgcggctcgaccagagcgtttccctattgaatctgcgacttaccccccgtgagggaggaggtgagctcgtactctatattcatcacagcatggctgatggtcaccatggggccgttttggtcgatgagctgttctcccgctacaccgacgtggtgactactggtgaccctggcccgataatcccccaggctacaccgctgtctatggaggccgtgctacaacagcggggtgtcaagaaacatgccctttcgggagctgagcgctttatgtcggtgatgtatgcttatgaccttcctgccaccgggacgccggctgtcctcgccgaacctggattgcctcaagctgttccggtaaccagactctggctcactaagcaggagacatcggatctcgcggcgttcggtcgtgaacatcggctcagcatcaacgccgtggtagcggcggccattctgatgaccgaatggcgactccgcgaaaccccgcacgttccaattccctatgtttaccccgtcgatttgcgatatgttcttgcccctcctgtggccccgaccgaaagcaccaatttactcggggcggcgggttaccttgctgagatcggacaggacaccgacatcgttgatctggcaaccgatatcgttgccacacttcgggctgacttagccaacggcgtggttcagcagtcgggcctgcactttggtacggcattcgagggaactccgcccgggttgccgccacttgtcttctgcactgatgccactgcgttcccgacgatgcgtacaccaccggatcttgcgattgaagacattcagggccggttctattgttcgattagtgtccccctggatctctactcctgcggtgtctacgaaggccaactgatcatcgagcatcacggacatatcgaggaaccggcaaaggctctcgaggcaatacgttccctgctgtgcactgttccctcggagtacggctggattatggagtgacgtgtagtgtccaccgttgtagataatggcttgcacccgggggtcggggccgagggcatctccgtgcgagacgacctgttgtggtgtcattggaagcccctgatgcctccgactgggccgtctgtgcggttgccggaacgggacctcaacagtcctgataccgagttctggatttattccgactggccttgtcttccaacagatccgcagcggcgttaacgctttcgtcaggtttgctcatccgattcgcgacctcgcgagcacgggtagcgtactgcggggcaaggatcgtgcggagatcagcggccagtgacctttgggtggtggcggagaatcgccggcctgcaccgactttcagccgcttgatctgagctgcccagaccggctgttcgataaagatccagaggatcagtgttgggactccggccctcaggcttgcggcagtggttccggcgccaccatggtgcacgacggcgcggcaggcgggaaatacggccgcatgacttactgatgtcactatcttgacgtggtcaaacttgggcacctgggttaagtccttaggtttaacggaaattaacgcacgttcccctaaatccgcacaggctgcggcaatcatcgcgaccgtatcggttggtgatacgatcggcatgctgccgaagccgaagtagattggcggtgtcccggcagctatccatgacaagacttcgttgtcagcggccgtcggtaactctagggttagtgcgccaacaaagggcctgcggtcaccgtattctgcccactctgcggccaacccaggaaagcagagctcgtcataggcctggatctcgagcgcccctcgtttcacgatccgtcgtgtcgagagtgaggttgcttttggcaggcctagttcgcggcgctgagcatcttcgggttttttcgctaagagccagtgtgctctccagaccgtcgcgagtatggcgcgatttaacggcgacggcaggctaggaatgattttgccgttgacccgtgcgggaacgaaatgcagcactccaaacggaatgccgtagtactcagcgacgttggcgacgaccccctgatagaccacgcccgtcatcaccaggtcggctccatctgccagtgacttcaagtccgtggccatgtccgcccatgcttggcggagttgctgcagagctttgatcggcggcagaattttccaccattggcgccattgactataggtatcgcgggccagaaactcctgggtatccggcccgtaggcaaccgcggccagcccggccgactcgacgaagcgaagcatgtcaggggggacaccaatgcgaacttcatggcctcggcgctgcaattccagaccgagcgcggcgaacggctcgacatcaccgcgagacccgctggcagccaaagtaaatttcatttagtgtctcactgctttcacgtaatttagtgttcgtgtgttgtgtgtgtgtcgtgaacgccaatggcatattgtcacggacgaatcggagtattcaatgattcagcatccacgatgagagttcggctatcaaacgtcgacatatcctgcagcggcagggacacggtgatcgtgttagcccatgccagtgtcatcgctctaatggccgcatgtttccgctcataacttgactggctgaacttaaattctttatgaactccttagtaaatcgacgacggtcgtcatactggactgtggcgagggaagttagcacgcgatcattaaatactaattttttctgtaaaataacttgataggaaacatttagaattttatattcgcctgcgtggtacttcaaaaacaggttgattgcccatgcgggattggctcgcgcgcgtagatagccgggccataaaaagtcgtcgaaaattagtatcccgcccttctctaacaggcgccaggcggtgataccatctgctaaaacatcgtcaccaaagtgcgatccatccacataaatcacatcaaatttctgttcttctccgagcagttgaggcaacacgctgcagcgacgatcccttacgcttggttaaccgcgctgcacacggagttagattgctatcaaagcgagcttcgaggcttcgcaaatccgacggtgcattgtgctggtgttcatcgctaccggcccatgtgtccacggccgtcaagtgcccttgggtaaaataggtcagcaagaatagggttgagcgaccctcccatgatccgatttcgaggattcgcacaggtgccttacgatcgaagacccttgaaaagatgtcgctccacacgacgatattccgatcggtcatatcgaagtatagttctttgaactgcccttgaactgattgctcttcgaattcggcgcggatctgagccaagtgttttgcagtaccggatggaattccttgcttgaccagaaaataacgcaataaggctgcaaatccgtgccatataatgataggatttactatacctgaataaaatagaaatgcaaacccgaagcgaagtaaaaatacaaggcatcggagcgtccaactaatttttgctgccactataatcacattttccttagatattattttgacacaacccaacgtgcccatttttcgcagctcaatactgtacactctgattccatgtaatgtttcagcgagattgcctactagagcctaattctttaagatcatagcacacttgagtatccccgggcgcgccgttacgccagcaggccgccatgaatgccccattgtaatgttgtaggtggagccagtgcgtacagggagcgatcctgctaccttggcaggtgactcggtggtggtcaacctcgatcagaagcgatgcgctcgcgcagctatgtgatgttgatcatagctcacagcgggccgtctgtcgataatattaatatattagttttaggggagggggatggcattatggagaagcctgatgaagcgtccgaacctgattatcgacgttggcatgcataatggacaagacaccgcgttctatctcgccaaaggttttgatgttgttgcgttagaggcgaatcccgttcttgttgatgccgcccgtattcgattcgcatcagagatcgagtctggacagctgcaaatccttccggaggctatagccgagacggagggcacattgccgctagctatctgtgacgaagagtcgctttggacttcgatgtctcctgcaataatcgagcgtaataagtcggtggcgggggtgacataccactacatcgatgtacctgctcggacgttcgccagtgttcttgaggaagttggggtgccccattacctcaaggtcgacatcgaggggttggacatgctctgtgtccacgctctgaagcaagccgacaatctaccggacttcatctctattgaatcgaacgtgagttctcccgggggcgcatttgacgcagcgtttgaggagcttgcggtgctctgggagctcggataccgccgtttcgcctacgtggatcagcgcaaacattcgaggtataagccgcctaatccggccagagaaggttgctttgtcggcgttgattttacagagcactgcagcgggttattcggtgaagaattgcctgttcgatgggagatgatagataaggccgtgcggaaggcacaggtcctacagcgccgctacaatgttaggggctttggtggcaaagggatgcgatcattgcaacgactactgccgatgcctagctatcgcacggtgtcgaatttcaccaagcgtccgttcggacggcgcgttgtcacatggacgatggaggtcgtcttgtccgggtggtacgacttacacgcccggctggattgagctaggtcgatcaggcgccgacttgaacgtgattgttgatgcgctgaacttcttccgaacagattctaagagtggagaagtcgactcaatttcttgtcaaatagcgaaatgattctgcgctaagaattttgccccgtcgctgccgaaggcattgtggttgtttgagccaagttagctggtttggcgggtaagctgaggtccaggcgcggtccgcgaaatcatgtcctcatgcgacgcactggccagttaggtgatctttccatgaacatccatccatgaacaaagttcggttattcgggatgcgtggccttcgtgagtgtcgaatcgctgggaccgcagcagtagctgtttagcgacctagtcaggcacatttactgaagattagattgtccagtgcgtcataagtatactgcagacagccagccaatacccgcgacagatgttcagtgacttcgcgatcaaggcgtgtagaaactcgcggtccatccagtccgtatgcactttcgtgattgcggaccgcggtcgagtcatgtggcctggggtccacgacctcaagctcgccgaacacctcggctggtcccaggatggccattaggtgttcatttctgtctggagagttatggctaatcgtaatttagttggatttgatgatataaagttgctcgccgggctctccttctgcgaacaccgtccggtttggtgagaaggaaaaccgggtgtacttgtgtgcttaccgcagaccagatatgcggttgcactaactcataaaggtatggtgctcgccaaattcatgtctatactaataaagattgattataagtttttcgcatcttagccgcgcaatttctcggttttcatagtggtttggtgtcatgcgcctgtcctcgtaggaggggccgctggacggttccgctccggccttctctcgcgatgttgaggaggactctaacatccttgctagcttcgttccacggtctgggcagcccgcacagccatgtatcacgacctgcttttggctgccaccggtcgaggctggggcagcggcaacgtaagccggccggaacggccagcgtctcaaagttctctgcgctctgagcagatcacgccaggcgttcgagaccaggtgcggatcgatgttctgcccagaacctgttttgtgcacttatcagcgatacactcctcgagtttacggcgtacgagggtgtggttcgacgagtaggtacggggtttaggcataacgggctcggttagccgcggtgtgactcatggcccgaaatatcaacagaatgttgtcttatcgggtcaagaagcatggactggtgctgctgcgcagtaagcatgcacaacccccggcaacgaagttcgtttccaacatcccaaatgtttaaaccttgaacatcaatcacgcagcgtttaggcagttttgcggttatcgccacgaccagcctagggaagtaacgtgtcatcgtccgcttgttgcggttgctcaacttgacccggccgccgtcgcgaaagcattctggacctaaaccatcccgttttgggctcatacgacgtatccgttgggttcgatcgaatcgacttagacgacatcggcgagttcttcttcttcttcttcttcttcttcttcttcttcttcttcttcttcttcttcttcttcttcaatgctaaacttattcccgtcggcgtgctatattatagggagctaagtgccccctgtagcaggtccggatgaagcgcgttgccttgacaacgcctggggttggttcttcgatcgagttttacaacgctcaattcatttcccctaatggcaccgtagtagttctggtgttccccagtgtgttctttgccaacttagcgccagcaatggcgacagtttcgtcgccggcaacgtttgctgcggtgttcttttccccaccgctattagccgggattttttcttgaggaggggcacttcggtgatcgtcttggtagggaagcgactttggtcgcaacgttgtttgatcatgggcctcttcaccgtggcggtgggttttctccccggcgtggctaccatcagcttggccggcgtaattgatcttgcttacgttgcggctgctgcaggcaatagcgttcggtggcgaatgggctggattggcactggctagttgcctaacacgcgccgggagacatgcgaccattataggaatggccatcccactcggcagctggtgtgggccttatgcttgccaacctggttatgctggccgtcaacttcactctacgaagagaccagccccgcgtctatgagatggaggttggtggatgccgtttctgcccagtgctatactggttattgtcgctctattacgtgcgcctgaacattcgctgaaccccggctttcgcgttctgtaagcgggatgagcagaaggatgtcaccgtgccttgcgcctccataaccgaacttttccggatccagcttcgacaggtcgttcttgcagtcggttccgtgatcaggctattcgtgctgagcttcgtagtcgggaacttatcttaatgaactacgtgccctcgaacttaaccatctaggggacctgatcctgattgttggtgcgctaggtgggttgtcgatgttcgctttttgtggtgccggcgccagtctggctggatcgtttcagccgacgaagtattatgttgtgcggcttggttttggcgcgtcctgggcgtttgtagtgatgccatttatgggtacttatgactccgtcctgatggatgttgttgtcgccgtatagtatgccaccgtggga

SEQ ID NO: 121 - DNA (genomic), 33312 bp, MYCOBACTERIUM LEPRAE; double-stranded, circular
  hypothetical: NO
  anti-sense: NO
cgcggccgcagtaatatccacaccgcggcgtcgcctgtgcccgggaggtggccgatgtggtcgctccggtgttgggttggacggccgaggatatcgatcgcgaggtggcgacttataatgcgcgggtggaggccgaggtactgtcgcaggcccagcccgacgacgtgtcggcggacatgttgcgagccagcgcacccgaggcgcgcaccaagatcatcgaaccggtgtcgctaacttgagcggacagttaagtgtcgcggggacccgcgcgaaagtgctgaatggagaagtcgtctattcggacggtgaggctaccgtggtgcccagcggggctagtgtcttattgtatcttattgtaatagtgacctgccggatgaagtgtctgtgctttttgcaatcccggtgctgcatcaagacacggacatcgtggtggttagtaagccgaactttttggccactatgccgcgggggcgacacattgcgcaggccgggctggtgcggttgcgctgagaactggggttgccggagctaagctcggtccacctacttggtcggctggccgccgaggtagctggctgttcatcacccgccgttagttgcatgaccgatgccagacactgttttcccacggtgtggtgcgcaagaaagatctacctggctcgtgcagcgagcgatccggccttagtattgccgtgcttggtccgaggtcgcatcgtcaagcatcggggcaacttgcaggggttctgcaagcccggtgtgcctaacgcggagacgctggtggagctgatttcgtcgaatgggctatgtcggctgactccgcataccggacgacccaccaattgaggctgcacatggtgtcctgggggtgtgcagattgtgggcgatccgttgtattccaatatcgtttacgtctctgctgacgattgcagtgcaccgttgcagtggttggcgtagcgcattgagttcgatgatccggtcactggggcgtgttgcgagttagtcagccgccgagaactagtccggttatcggggccaataccgtcttggttgacagtgtaacttctgtcttttcgatgaaatcggttgctgaattgcgtcgttcgattctggaaaggcgtagttacaacgttggaaaaggccatcggtaagttcaaccctgaccgcacccggctgccttgagcccaaggcatttcggcggtactatctgccgcactatggcggagtcagtgggcaactggatgatagtttccggccccaagatgcccaacgagcatgcagtggcccaggttgtaggacggggcgcagcggcttgaatgtggcgcgatggctagcgtccgtcgttctcgcagtctgtctggctggatgtgttgggcgccaggtatcggccagttctcgcgatcagcctgggacttttcaattcggcggcttgaatcgaacctacgtgctgcacgttccgccaggctctcctgtgggcctggtgctcaacctgcacggcggaggcggcactggagctgggcagcagggccttaccgattttgatgctgttgccgacttaaacaatctgctggtggcctaccctgacggttacgataagagctgggccgatggacgaggggcatcgccggcggatcgtcgacatgtcgacgacgtcggtttcttggttgagttggcggccaaactgcagagtgacttcggtgttgcccccggccatgtctttgtcaccggcatgtccaacgggggtttcatgtccaacaagctggcgtgtgatcgtgccgatatgtttgccgctatcgccccggtggccggaacattgggcgtcgatgtggcctgccatccgtcgcaaccggtgtcggttatggacgcgcatggaaccgatgatccgctggtgccgttcaacggtggggacgtgcatggtcgcggcggggtcagtcacgtggtctcggttaccaatatggtggaaaagtggcgcacggccgatgggtgtcaaggcgatccgtcacaacaggaattgcctgacgttggggacggaacattcgtccgccgctttgattacactgtgtgtgcaaattccgccgaagtggtcttctacaagatcaacaaaggcggtcacacttggccgggcggcaagcaatatttacccaaggtagtcatcgggtccaccacgtgcgtgttcgacgcatcggaagttatcgcgcagtttttcctgacgcatgctcgcagctaattcgagcaatcgccgggcgctgccagcgggccgccacaccagggccacgacggaatattgactactggttatcggaaggaactatgctgcaacgcatttacgcccagaaactgatgtcggcttgactccaccagaccatatccgagatgcgaagcattacggccacgccaactcctgttggttcgcgccgtcgtcgtgttgcttgtcgtaggatcggcttggttgaacgtggctttgtgctggctaggccgtggtggtttgttgggccaatccggttacgggaataatccgcggaggcatccgccgggtcatcgtcgacaaagcgtcgtacaccgccacgtcagaggtctccatcaccgcgatgtcctggtactagcaatctaggttttgttcctaacggtccgcgatctcagcagtgtgttgcctcgatatcgcggcgtgtcaatatgcgaccggccaggtgttcgcccagcgtgatatccgtctcgggcgtagctaaagtcggcctcggtcgggtctggtgctgtgggtgcgtgacgccgtagcggctcagccacggcggtcggcgtgcggggtgtgccggagcgaaactcttgcgggtgccagtgccggcgaacagcgtcaacggtgcggactcggcggcgtacagtgcgatcctgccgtcattacctgagattgttccggcactcgacggattacctcgtcggttgtgagcagcttgtcgagcatcaccggggtatagtcacggactcgcggggtcagcaccagtggttcgattgccgaggtcggcatccgccaccctggccagctgatctatgacggacgtcagctcatcaagactgcagtggcccgaagacattgtaatacaaggccagtagaaagtgcgcgtaagctgcggtgctaaccgactcgacttgggcacgcagctggtgctacaccgaattgttgccgcattatgcggcaacaattcggtgtagcaccagctggtcgtcagagttaccagcaggcccagcacatcggtcttcacctgcaggccggttcagcctacgggtgacgctgtggtgaatggggtgtgggtgcggcgcgtagcgcgcagccgcttaccccagcggggtggctacttctacggtgaagatgacaggaacgctgaccggacccgtcgctacgactccgtcgtgcagctggccgatgtcttccgatggccactcaccccagctgctgccggcgaacgacaccgttagcgcgtgcctagcggcgtgcacgccctccagccatccgtggatgtcagagcacccgttggaccaagcggcggcatcagctgcggtgagcggacccagcagtcgcagcaaatccgcgatcgcttcggtgtcgtgaccgacccggttatccaacaggttctgtaactggcgctcggttgcggtgatgacctcgggattgcatagctcgcgcagttctacgtggtcgagtagctgtccagcgagagcgccgcgacgctcggcaaatagggatatagagccctcgtgcatgaacgttccggtgtagccgaacaccagtgacgctgtaaacggtaagagtttcgccgttttcgtttttgcctactcggacctggcgcaaagcgatgccggtcatcagctcgaccaggtcggggacgtcgtaaacgtcctgtaggcattttcggacggtctccagcacgatgggaaagtccaggatatttgcgggttacttccagtaactgggcggggcgctggcactggttccacagcggcgagcagcggccggggtgccggcgggcagcaacaaagcgtgggccgcacattcccggaaccggcaccgtaaacagcgctgaaccgcccacttctgcggtgacaatcgggtcggtctccatcggggtcgaagacaaacaacttggcgccttgcggatatcgaaggcgaaggcagacgtgaaattaggaaagagcggtccggcaattaaaccacgatgccatagtcggaggcagtcggcttctggtcgggtctgtagcgtgtccccgcagccgccgacccaccgccagcgccagcggctcgtgtactcgcagccaatacggctaatacaggattcaccctccagttgctaagtagtcgcggaatcgcttgaccgagcagagtggtgtcggtgtgtagtgtcaaagtggtggtgcgctggtcgtccagcaacacccacaggttggcggtcgcgtaatagtcgaaattcgagtcagcgcaacgcttgccgaatgtgtcgtggtccaggcgggtcagtgctccggtcgcggcgccgagttgggctgggcggacgacattatcgctgcgtcagaacgacaattgggccggttggtccggcgtggggatgaccagaacgcggtcgtgggtagtcttttctcggtgatccgccagctgggggctcccagctagataacgtcaccagcgcggtgatgcatacaccatctcttcgtctaggtcgcttattcgcgaaggactgtccggatagctggttagatacatgctgaacagcccgcgatcgggaatggcgccaacggaggtgacagccagccgctgcgcaccaggccgcgcggtcgtagaccaacagcgttcgcagctcggcgaactcggtagatgtgatatttgctgctcaaaaggtccaggtgtgggctcgtagaagctgtgcggcagcaccgcggatgggatgtcctggcccggacggtgttgcaccactagccggcgtccaatggtttaagcacggctgtcgtcacggtctgttggtccagaatatcgagcgggctggtagggctacacgcatcgtctcgatctggttggcgagagcccgctgggtgctgatcgcggaaccagtcaggtcggtacggtacttggggaacagcacccccgcatggtatcttaccgacgcgatttctggctcgcccaatgcgttgcaggccgctggccaccgatagtggtgccttcacgtgttgtatcaccagatcgattgcgcccatgtcgatgcccaattccaagcttgaggttgctaccaccgccttgagatgtccgcgtttgaggctctatttcgccctgtgcgcgcttgcttcttgttgaccgagtttgttgtgagcgcgtgccagtcacgggggcgctgaacgtagccgatgcgccggtgtgctgccgggtatctgagggttagcctccgacgccgacaaaatgccggaccgttctgcgtgaatttcgttgatctgtatggtaagccgctctgcggttcggagtgagttggcgaacacgatggtcgagctgtgtgatttcatcacattggccaagtgtgcctcgatgtagggtcagatgatgttatttgccaaattggtcatatcaggtacaggaacagccactgtgagttcgatagccttggtcgatggcggagccatgatcgtggttgggttagtaggggggactagtccagacaggaaccacgcgagctcttcgggcggacgtacggttgcagacaaaccctgcgctgtacaggccgaccttgctgaaaggcgtgtgacaggtcgtcgagccgcttcagtggcagggctaggtgtgcgccccgctttccgccggcgatggcgttaatcgtcgtcgacggtcaccgtctgtatgccgaccagcgtctcgcgcgtggtcgaagtcagcatcaaaagcagtgactccggggtggtgatcagcacatcgggtggctgggcaagcagttggcggtagcgtgccggcggggtggcaccgggattggatcccgacgtggatatcgggcccgctccgggcggtatgctaggcgatccgggtgagctctgccaggttgggtacgcaagttgcgttcgatgtcgacttctagcgtcttaagtggcgacacgtacagccaagcgagttatcgccggccggtacgacgacgtgacggtggccgcacaaactagcgatggttcacagaaaggcggccagtatctcacctgaaccggttggggcgataactaacgtgttatggctatccgcgatgacttcccaggagctggcctgcgccgtggttgagatgtcgaaggtgctggtgaaccattcgcgggtgatcatgctgaactggcccaacgagttttgggtacggggggcagggactgattaggtgacgtagtgctcgcctagccatggtgtcagtggcgaacgacaattctgcagacgaaagcacctcatctgcggactattgcggcggctgacgcgcgatcgccatcgcatcggccagttctttggaaatctcgggcacccgggcgatggcgtccagcagcgcatgcgcgcaggagtcggcaaggcgatcggcgtcggtcgatgggtccatgattcgttgccggcacacttcgaacgtaaacgccagccagccgtgcacgattacccgcaggtctcgctcgatatccggatgcagtttggactccggtactacgctcactacatccccaatccgggacatgatgtgttccatctggcggttcttggcttcgtcgtcaatgccgagcagaaccgggtcagaacggccaagaccgacgtaggctgcccatgcagcctccggattctgcttgtggtaggccatataggccagtacaccgacgcgcacttcttcgaacatggtcaaaccagcaggaggcggaatgttcgtggccgcgtacagtcgatcagcttcgtccttgacaaccgcggcgaagaacgcgcgcttgtcagggaaatagtgatacatcagcgcgcgcgacacccccgcacgctcggcgatctcatcgatgcggacttcgtcatagggtcgcttcccgaacacttctgctcccagtgccagcagctcagcacgccgatcctcgggagataaacgcctcctggctgtggtcatgtgacagaatattacccatggcgggtatacgacctgcgggtgcgtggactcagccaaactcttacctatattttatactctgcgctagtggcaactcgtcggagtagttgacggtgttggtggagcgccgcatgtaggtcttctgcgcgtctaaactaactttctgcccgctgccggtttgcttctcgccgccaatcttagcgtccgatgtgccgatgttgacgttggtgataccgcagtccggtccatttacggagcgctcctcctcacgtaggttgatagtgaaggttgacgataaaagtccttgtgacacagtgttattaagcgagatcgcttcgtcaaaattgtcgtaggtcagcgtgtagaggatcggtgtaaacgtttcggtggtcacgatggtggtctgcgacgggattcggatcacgccggacagcaacgcacctagcgtcgacaggtcgcttataggacagctgcctaccacgcggagaccaggtgcgccactacgttgtcggccactaagcggtgtatgataagagtttagacaaaatggtgtaaagatgaccggcggtgccgacgttggcaaaagcgatgccggcaccgccaggtccaggtcggcctacggcgtcacgagggctacgttgttgccaccacctccagcaacgctagcccgaacggcgccgcgacgcgtggaccagcttgttgatccattcgcaccgacccggtggccgggacacaacgctatccgatgatcgtcggccagctgccccgttgagctcgtagtcgctatacaattaggctgctgaccgctgctggcgacccgccgtctgcggtggctcgcccaatcagcacctggcaggccggtcctgtcaacggtgtcagcttcgagggcttccacaccacggtgatgccacacaccagtgctattgccacgttccacgtccagactgcgattgggaagttgaacgctgtgatcgcaccgactacgccaagcggatgctagttatctataaccgatggttagggtgctacgatacgctggtccagccgtagagttggctctacaggatgaccgtgaattggactttgattttcctggctttctccatcctcctcggaagcgatatttgtctacctcgattgttactagcgtggcggggtcgttcttgtgtgcgggtgagtagttagccgagccggactaccaggacaccgtgcactggcatcggtgtgcttcgctaggaccaaaacgcctgggtggtatccgcgatcgtgcgatcctcctactcgggtgtggtttgtgcgatggtgagcaggacctcgctggtaatcggtgtgctgggggtaagccgcgcttgcctagttttcccagcgttgcgtgggttccgttcgagctgccgatcgctgtgagggccgtcttgtttacccgggtgcgtaactcgtttgtggtcataagtgccgttcttccccatcgctccgtgcctcgcaagcaggtggtgccccgctgcatcgtcgtcggcgcgagttgacacgctaactggggtgtttccttggagagcgtttcgtatagcgcgtacgggtcgtgaatgttgtgggctatagccctagccaactgcctgatgtcgtaactggaatcgtaggaagcgtcctcggcggcaagcaggaaatcctggtggacaatcggggcctacggggtgtcactgcgataataggctcagtctttgagtggctattttttcagcagtcgacggaaagtatttgctccacactgtggcagtgtcggcagtttccataacagcgtcgtaacgttcgcggctctgcggcgtcagtgcgacaccgcacgcttcgatttctccgaaccgcacctgaagctgtctttgggtgagggtggcttgatacctggaccgttctaacggaacaggtttggctcggcgaatgcacgaaacgaattctgttgcaacagcacatcgggtccgtgggtgcatgctggttcctgtatggcatcgatcatagttatgccacgagcagtcatactgttgtgtagatagtcgatgtcggggacccgcggggtcagatgattgatgtaggtgtagccgacgcaggcgatgtcggaagccattgccacactcgggataactcgccgtaccaagacttcttgacaggttcgcgcaatagcacgaatagcgctaccgcttcagagaaaaacggacgctcctggatcgggatcggcgtcacagtcgtcatccggcggcgatttgtcgggtctgagccaacaatgcggggtcgaacagttgacgttggcccaggaaggttttctacacaggtgcgccgactggcttcgaggtatcggagaatcgcgggtggctagcatctaggtgaaaaaccggaacatgttgtgctccagatcatttacatcgatagatcgaaaattattgtacgacaatggaatgagagactattcggaacgaagatcgtaatagtcgtccggcaacatgctgaacgctacgaagaggtcagcgacggcagtcaattcgtccgggttgcctacacggatagagtcgtgtcgcttagcggtgacccgttacattgaagcgcaacactgtacacgccaatggcgtgtcaggtagttggaggtgacttaggctgctgactgcgaccagcgtggcgtatgcgggcacctcgctgggctatatggccgacaactcggcagcgaatcgtacacagttgccaggcagccagctgtattgggctcatgcggagacgctgcgatagtctccggtcatgggtgaaacccagatgacgccaactggatcttgatgtgtgagctggtagctgacgggcacgccactttgttggagttggcggactgtcggtttcggcggttcaggagcggacgcgcaggttggagtatcgcgttgtggcgtctgaatattcggggctgatcaaccagaaggcggttgggtagctgctgttggcgttcgtggcaatcactcctcgtgatctgtcttaacccgatgatgcgcccacccgcctggagcacatcgaggaaatcgagtcgtgtcactcggtggtcggtgaagaaagctacatcttgctagtacgtgtcgcgtctgcacgtgcgctggaggatcagctgcaaaggatccgggcagcgacgaatgtcacgatccgaagtacggtaatactaaaactatttttacagccacaggtagcacatacccggaaattttactacataaatatgaaatacaatgtaaaattctgtaaaaaaaccactagcatcatgctacaattgctgttttaagatcggttgcattcgttggtccacaaacagaaccagaccaggtgcatgacgcgcttgcgcacagcattctgaccggctttttcgacctggtactggttctgacctgctcgatcggctcgtatctggtcgatgtccgaaccggtcagtgctattccgacctgttcaccttctacgcttcataggcaccggacataaatcatccggcgctggtcaagaacaacgaaatctgtgctgaactcatagcggtggtgctgaacaagcccagtaatttcgacgtgtactcggtggcaatggccagcttggtcgagaccttcgggcgcgtgctgggtgatccggccttgccgcatctgttcttcatcgaaggtgatgtgctggcggtggagaacgcattcaagtgtcgcgttcgcctggacgggtcggtacaacgaagcctacggtatcgatccattgctgggcactcgggtgctgcacttgcgtgggtatttcgcggccgcagcggctacactttgccgctcaccaataccaagtctattgccgtggcccggttctagacattcgactggagatgcatttacgtgccttatatctggtttatctggtccggagtcgatttggatgtgctagaagccgaatcactgagtcaggtgcgcgcggcattttagacacacctgtactccatcgctttactttctggccgagctgatccacggggaaggtagcgaccgacattttcggccagagttcttcgtggcgatgcgtgagttgcgtgactaatacaatgctctgctgattttcgacgaggtgcagaccggctgtgggttgatcggaaccccttgggcctaaaaacaattggatatgcaacccgacgtagtcgacttcggcaagaggacgcaggtgtgtggagtcaaggcaggtcaccgagatgacgaaattagccgacaatgtgttacggtctcttcccggatcaactcgacgtggggcggcgatcttaccgacctagtgtgcgtccgacggatccttgaggtgatcgaaaccgaggggtggttcgaatctgcggctcagcagggcagctactttgcgcgcttggctcggcgagttcgccgacgatttcctggcactgattctcgactcgagcggccgcagccggtcggatgtgtgctttcaacatgccgaccagtgccggtcgcgacagaggtgatccgccagctgttgctacctgcggtgatcgtgctgcccaacggcaacgatggcgtatggttgcgtcccgccttccttgtggtcacgcggctgatcgcctgccgtgtgcggcgcgttgcaggcgctgacgaggccgtgacggtgggtcgccaaacgggtttgccttttttgggattgttgtggcggatctatgggaccagagcgacgttgtagcggccaacaaccggatatgaggtttgcgggggatggataaagtacgtgaacgatcaggtggtggtgatcatctgggtaggaggacggtgaggttcgcgccgcgatccggttcgccatgttggctgcagtagccggcgttgcttcctgatcgccggcgttatgggtcagccctgcgggggagcgggcatcgacgcggtggcctgtgaccgcctcagctgacgttgctagcgttcgggggtccgctgattttgttcgccgcggggcttcgtgcgtgcctacttcgtctggcacgaccggggtacctggtggtgctgggacggcgccggctggtttttgttgacgctgatggtgttaacgctgtttttaggtgtgccgccgattgccggctcgataatggcactttgaatcgtccgctctctcgccaaacctgttctgtgaattctaccgctgatgctaggtccttggtcttgcgcaggcgaaacgatgggacgaacaaacgggacagaagtagctatgggagacacctatcgtgatttggtcgaccatttgcggacgacacgggtcttcgttggtgagtttctgatcgacgtactgcactgacttggtaacctttttgtcgtggcggctatgatcggtatggttagccagtcttgcggccttcgggaccggaaatcataaccagggcatgacggtaagtgtagtcgcgatcaccgtgacggtgctcgtcttgctaacgagcaccggtggatccgcaagatcgcagatcggtggtaccccgaacatcccgaagtccgctggctagttgcgaccagtgtcctagcgtgatcaactcgcggttgttcagcgtcgactagtctggggtggtaaaaaatctttcgctctttctttaacttcatttaacgggcagccgggatttcgtgacgtgctttgccgccgctacaggtcgccagtcctgctggacactggcgggaacctaatatccgtgggttttaccagtcgtatcgagcggatatcactttgtacactgtgatgagtgaccaccgtggtcccggtgataacctcgacgtgaacacgttgcgcgctcgcttccgtgtacatcaggtacgctccgtatccggtggaacactcaacggcaatcatgactaaccgactcgaaggcggacttctcactgggactgggagtaatgtcagtcagatgttgccaggagaacaagtgagtaatgcggaattacgtcccaaaccggggataacgaggtcaccgctctgtcgaactgcatgttgccacgcatttggagcacctggtgttgctccaaatcttggtcggtgtgatcggcacctttgaagacctggattttggcgctgtggcgaacttgctgctggcggtagacgaagcatacatacggttggtccgctcggcaacttcggactcaacgctcgttctggtggtcgattcacgcgacgacgaattggtggtggaggcttctgcgatttgcgacacctacgatgttgtggcagttggcatttcctaatgtcgttgaccgaccatgtacagacttgccacggccctataaaaccggcagcctttttaaaggcacgaagggcggctctgcggccggtgacagtgcgagctaccggcgattagacttcgccgccttaacgaatacgccgagtcccggagatgtttcgtaagcttgccgtatccaccgccgactcagcggagtcctgacgcctccggtaggagattgtggagcgctgcttgtcgctggttggtcacatcgccaggaggttcgtaggccgcgacgcaccgtgtgacgactttgtccagatcgtgcgggtcggattggtcaattcgggtagtgcgtttcgaccccgaaaccgggatcagatttcatcttgtttgtggtgcctgcgatcatgagtgagggttcgacgttacttccgcgacaacagctctggtcggtccaggttccccggcgtctgaaggaactgcacttacaacttggcacagcgacggctgaactgtcacaacgtcttgaccgggcgcccaccgcatccgaactcggcatggatcgtaacgaggttgtcgaggggctggttgccggcagttcccagaacaccttgtccatcgacagcggcaacgatgacgacgacgtctgcgctatcgccgatacgttgggcgacgtggacgcaggctttgagcggatcgaaaatcgggaggcgctatctctattgcttgaggtgttgcccaagtgggaacgatatggcatttagtgcttcgcgtttcgagtcgatgacgcagattgctgagagggtaggaattttacaaatcgatgtgacattggctgttggctacatcgctagcgcggctgtgggaccagctagagtaggccagccttacttgatctcggcgagcaccgtgccttgagtgatggccgtgccggcttcgaccgccaagcccgttatgataccatctttatgtgcggtgactgggttctccatcttcatagcctcgaggaccaccactaggtcgcctgtcatcactgtttgtccctccgcaacggcgaccttgactacggtgccctgcatgggcgcggtcaccgcgtcaccggaggtcgctgcgccggtgtgtccaccgcgcttgcgcggcttgggttttttgcggataacaccggctggattgcagccggccgggttagctaatgcgagatcggcgggcagcgagacctcgagtcggcggccgtcgacctcgacgatcaccgtctgttgtggcctggtgtcctcttcgtcgaggggctggttgtcgatgaagggttcgatggtgttattccactcggtttcgatccagcgggtgtgcaccgagaagctgttgttgtcgccgatcagcgccgggtcggataccacagcgcggtggaacgggatgaccgtggccaggccttcgacctcgaattcgtccagtgcgcggcgggcgcgcgccagtgcttcctggcgagtggcgccgtgcacgatcagcttggcaagcatggagtcgaactggccaccgattaccgaaccggtctctaccccggagtccaatcgcacgccgggaccggtgggcgggtggaacttgctaacaggccccggcgagggcagaaagttgcgtcctgcgtcctcgccattgattcggaactcgatggcgtgaccgcacgggataggatccttgatcagttcgagcttttcgccgttggcgatcttgaactgctgcagcaccagatcaatgcctgtggtctcttcggtgaccgggtgctcaacttgaaggcgggtgttgacttccaggaacgagattaggccatcctggccgacaagatattctaccgtcccagcgccgtagtagtgggcctccttgcagattcgcttcgcggattcgtggatttccttacgctgggcgtctgttaggaacggcgccggcgcctcctcgaccagcttctggaaacgccgctgtagcgagcagtcccgagtaccggcgacgacaatgttgccgtgctgatcggcgattacctgcgcttcgacgtgtcggggcttatctaggtagcgctcaacaaaacattccccgcggccgaacgcaacggtggcctcacgcaccgccgattcgtatagttcggaaatctcctcgagggtgcgggccactttcatgcccttgccgccgccaccgaaggcggccttgatcgcgatcggtaccccgtgttctttggcgaaggccaccacctcgtcggcgtttttgaccggatccggggtgccgggcactaggggagcctgtgcgcgggcggcgatatggcgggcggtgaccttgtcgccgaggtcgcggatcgattgtgggctgggcccgatccagatcaggccggcgtcgatgacggcctgggcgaagtcagcattctcggcaaggaacccgtaaccgggatggatcgcgttggctccggattttgcagcggcgtcgaggatcttaccgaagtccaagtaggactctgcggaagtgtgacctcccagcgcgaacgcttcgtcggccagccgcacatgtggcgcctcggcgtcaggctcggcgtatactgccacgctaggcagtctcgcatcgcgggccgcgcggatcacccggacagcaatttcgccgcggttggcgacgagaaccttggcgatcctcgagctggcgtgactggccactgcgcctcctgtttggcggtattttaagggattttttacaattatgtcgcgggaagtctaagcgtcgtgtcggcgacgcgaccaggtggtggtgggggtaaccggtctgtttagaatggctgattgatccgggcaagcatcgccgacattccgcgtaactgcagcgggctgatcagagcagctacgcccggcccgacataacataatcgttgggtaccgttaggtgtagcggcggattggtggtctaagtcggcgactaagacagcggccaacccacgggtggtcggcgcttcggccggagcgctgaagtacaggcgcacccagcttcggtcgtgtggatcgatgtatcgatgtgcagaaaaagcgaggtcggtattcgggcgccggctccatcgctgcttcggccgagtcggcgtgcagggctggcaggtcatcggcaaattccagcaacagttttagctcgtcctggcctcagacttcgtcgaagtctgaggccaggacgccgagggcgcgggtattctcacggaatggctatcagacaggtacggctccggggctttcgcctgcagtgatcggcactcgtacggtgttcccccactcggtccacgagccgtcatagttacgcactcccggtttgcccagcagatgggtgagtacgaaccaagtgtggctggatcgctcgccgatgcggcaatatacgatggttttatcgtttggggtgatgaagtcatagagccgttccaattcttcgctgctgcggaatcgaccgcttttgtcgactgtcatttcccacgggatcgacctggcggtggggatgtggccggctcgcagcacactttcttcgggggagtcgggcatttcggtgcatttgccggtgtactcgtcgagggatcgcacgtcgatcagcggctgagtgccgaggatggccaacacgtcgtctttgaatgcgcggatgggtgcgtcgttccggtttaccacgggatagctggtcgatgtcttattcggcacggccaggctggtatcccggcgttcggcgagccatagatcacgaccgccgttgagcagtcgcacgtcgggatggccgaacaaggtaaagacccacagtgcgtaggccgcccaccagttgctcttgtcgccgtagatcaccacggtgtcgtcgcgggcgatgcccttgcggttcatcaagtcggcgaattgctcgccagtgatgtagtcacgcaccttcgggtcattgaggtcggtgtgccagtcgaccttcaccgcgccaggaatatgtccgacatcgtagagcagtacgttctcgtcggattcgactatagccagaccgggtttgcccagatggaagtacagccaatcaccggttactagccgttcggggtgggcgtaagccgacagggaagggcttggatctgtgggtagcggcacaccttaaagcttactcatcctgatgttgttggtgatcatgcttagagtctgaagcgctgatgtccattgggctatgtcagtctggtatctcgggtagtccgagcaacccatcggcacacggttcactaaccgtggcctgggtactagccggaggcagtgcaggtaacgcatcatgctgctgaggtgcaacggctgaatttctagatgaccggattggctgcccacattgcggcaatagacaaccccgcacgggacagtagcgaccgcgtcaaaggcagtccgatccctacaacggttgacggatcgccgtagaccgcgtcgatgaaccagccacctaggccgtcaagcgtgaaccctccagcgacttgcaacgattcgccgcatgccaggtaggcttccaggtcttcagctgacggatttccgaaacatattgtggtcattgatgtttcatcgacagaataagtagtttcgttgtttagtaaccggataacgcagtgaccggtatagagttggccggcgcgccctgccatcgactgccactgttgccgtgcgttggcgacggactgcggtttgccgtacagtcggccatcgatggaaagttgtgaatcacagctaatgacaacgcaatcgtctgcgactgcgtggctcagagctgccgcgacttgggtggctttggctcgggcgagtgtgcttaccacatcgcgcggcgaagtgtctgacccgaggcctgcggtgaccagatcttcatcgacaccggaagctgcgaccagtggatcaatgccggcttggcgaagcactttgagtcgaccggcggaagcggacccgagtaccagccgggtcatcggcgcatatgcgtcatctcgtgaagggtgatgcgttgccagctgaagaccgggtaccgcaacttgtcgaccggcaggccccatcgagtgggttcgggctgcttgacctgcgatgcaccgccgatgctgctcagcaccacgattagcgcggccaactcctgatcggtgggttgtcctttggttatttgaatatgtgggttttgggtcgtgggcaatttgttcgtctcactcccgtcgttcgctgcactcacagcggaatgttcccgtgcttcttggggggaaggtgtgcgatcttgcgctccaacaggtgaagcgccgtggcaatgtagccgcgagtgtgtgacggcgggatcaccgcatcgacgtaacctcgttcggcggcgatgtacgggttcaccagggtgtcctcgtactcttgctgcagctgcaggcgtagctcatcaacattggcgccgttcttggccgcttgggccagttccttgcggtacacgaagcctactgcgccggaggcacccatcaccgcaatctgtgcggtcggccaagccaggttgacgtcgcagcccatatttttggagcccatcacgcagtaagcgccaccgtaggccttgcgggtgatgacggtgatcttgggtacggtggcttcgccgtaggcgaagagcagctttgcgccgcgtcggatgatgccatcatattcttgctcggtgccaggcaggaagcctggaacatccaccaacatcacgatcgggatgttgaagcagtcgcagacccgcacaaatcgggctgccttttccgaggcgttgatgtctagacagccggcgaactggatgggttggttggcaacgatgcccaccggtcggtcatctatgcgtccgagcccgacgacgatgttggtggcgtaaccggcttgcacctcaaggaactcttcctcgtcgaggaggcgggtcaccacttcgtgcatgtcgtacggttggttcggcgagtccgggataagcgtgtccaactccaagtctttagcggtcaggttgtcttcaatggagccgtgaggaacgggcttagaataccgcggcgcgtcggtgaagttgtttgacggcaggtagctcaacacatcgcgcacccaatcgaaggcgtcttgctcgcccgatgctacatagtgtgcggtacccgacttggccatgtgggtatgggcgccacccagctcctccatggtgacgtcctcgccggtgacggtcttgatgacgtcgggtccggtgatgaacatctggctggtttggtcgaccataaccacgaagtcggtcagtgctggggaatacacgtgtccaccggcggccgctcccatgatcagcgagatctgcgggatgacgccggaggccaagatattgttgcggaaaatccggctgtacaggccgagcgagacgacgccttcttggatacgcgcgcccgcgccgtcgttgatgccgataagcggacggccggtcttgatcgccagttcctggaccttgacgatcttctcgccatacacttcgcccaggctgccgccgaacaccgtgacgtcctggctgaagatgcatacgtcgcggccgtcgatggtgccgtagccggtgaccacgccatcgcctaccgggcggttttcaccgaggccgaagttggtgctgcggtgtctggccagtgcgtcgagttcgacgaatgagtcgtcgtccaatagggcgtagatgcgctcgcgggcggtaaacttacccttagcgtgtaccttctcgaaggcagctgcaccgaccggatgcagcgcttcttcggtccgcttatgcagctcggccagcttgcctgccgtggtgtggatattgatcgtgtgctcggcagcgcgttccattgaatgagccgagtggtcggtaacgcttgtcatgggagtcgatgttatcggcagctgctgtggtggtggttacgctgggtttgcgaggagatgagttgggtagtgatctactcaagccgccgctggatccagcggcactgcgtgctgagctgattgggacggggctccggtggcgtcaactggacgtcgtcacgcaaaccggttccacgaacgctgacctgttggcgcgggcagcgtcaggcatcgacatcgacggagcggtgcttattgccgagcaccagaccgctggccgcggcgtcacggccgcggctggtcggctagccctcgcacacaaatcacgatgtcgatcggtgtgagtatcgctgacgttccggttgccacgtgggcctggttgtcgctggccactggggtagcggtgctggacacggtggccccgttgattgacgtgaccggcgttgacgccggcctcaagtggcccaacgatgttctggccggtccaccaggctccaaaggtaaactcgcgggcatcctggctgaggttgtgcgaccagtcatcgtcgtcggtgtgggacttaacgtcacgcaggccccaaaagaggtcgacggtcctggggctacctcgttgcttgaccttggcgtgccggcacccgatcgggagcagctggtgtgctggctgttgcgagaactcgatgcgcgggttggccagtggcgaagcgccgacccacagttgatggccgattatcgggcgcgtagcccgataatcgggtcacgtgtgcgtgcggagctccccggcggcaaagacgtggtcggaaccgtgcgcggcatcgatgaccagggaaggttgtgcttgaaaacagaagggcctaccaaaggacaaaccgtcgtgatttcggctggtgacgtggtgcatttgcgctagtttcatccggggcgccgcttgcgttgggataggcgttttgcaggtattctctatagattttctttgcaaaacgtcaatctcgacgattccacctcagacgaacttgtgaccaagcccgctaatgtcgcggctatgaggtatccgggtaataccttggttgctggcgagcaggtggttttgcatcgccatccgcactggaagcgtttgatttggcctgctgtggtacttatcttggcgaccgggctggtctcgtttggttccgggtatgttaactcgacgcactgggcgcaggtcgccaagaacgtgatctacggtgtcctctggggcgtctggctggtgatcgtcggttggctcacgttgtggccgttccttaattggctcaccacacatttcgtcgtaactaaccggagggtgatgtttcggcaagggacgctaacccgcagcggggtcgacattcctttggcgcgcatcaacagcgtagagttccgcgaccggcttttcgagcgaatgttccgcaccggaacactgattatcgaatccgcgtcacaagatccagtggaattctacaacattccgcgcctgcgccagatgtacgcgttgttgtatcacgaggttttcgacacccttggctccgaagagtcgcccagctgagacgcgggactcaaatccaggcggcgggagcgattgcgccaggcacgcaacagggcatcgccgaagtcttcgaagacgccatcgatggcgtcttcgaagacttcggcgatgccgcccgcagtgagggcagattccagcgtcttttcggggttgcgggcgaacgcgtcgggaaacacccagcgccggaatgcccagaaacgaaacgccatctgtagcagattgccgatgatgtaggctgataggaagtcggcgaggttttcaacggttagtgacaccgtgggcgcgcgcagttgcaggacatagctcgagaaccacagcggtgccatgcttagcagcacccctatgccactgaaggcgaaaaacagcagcgcctcattatggcgctcgcggccgccacggtcccgaaagctccattccctgtttaacacgtaggatgcgataacagcgacgatgccggcgacgaccttggcggtcaccggtttgggctcgagaatcgtcagtttgagggtgtagaaaattgctgaatcaatgatgaatgtggtgccgccgacgatggcaaatttaatgagttcgtggtagcgctgcgcatacggctgcagtactgtgggcaagcgcgtgatcgtggcatcgggaaaagacacaacacgtcagtgtacggattgacgtaaaatgctacctaacggttgggtattactacgggtcaatatgctctctgtcgccatgacaccatgatggctgtgccgagtagatgctcgcttggagttgctccattggttgccatggtcggtggcggtcaactggctcggatgacccatcaagccgcgatcgcgctggggcagaccctgcgggtgttagctaccgctgcagacgaacccgctgctcaggtcacccccgatgtggtgatcggctcgcacactgatcttgaagacctgcgccgcgttgccctcggagccgatgcgttgacgttcgatcacgaacacgtcccgactgaactgctggacaaactggtggccgaaggcatcaatgtggcaccgtcgccgcaagctctggtgcacgcccaggacaagctggtcatgcggcggcgattggcggcgctgggagctgcgatgcctcgcttcatggcattagacagtgtggacgacttggccgaaatcgatgcgttcgcgcagcgccttacgggttcgaaagatgccccgatggtggtcaaggcggtccgcgggggttatgacggccggggggtgcagatggtccgcgactcggcacacgcccgcgaggtcgcctccggatatctagtcgacggaatgccggtcctggttgaggagcgagtggaactgcgtcgcgaattgtccgcgctggtagcgcgctcgccgttcggccagggtgcagcctggccagtcgtggagacggtgcaacgggacgggatttgcgttttggtggtcgcaccggcgttggcgttggccgacgacctggcctcggctgcgcagcagctggcgttgcgattggccgctgaactcggcgtcgtcggtgtgttcgcggtcgagttgttcgaaaccgccgacggtgctttgctggtgaacgagctcgcaatgcggccgcacaactccggacactggacaatggacggtgctcgcaccagccagttcgagcagcatctccgtgcggtgctagactatcccctcggcgagaccgacgccgtcgcgccggtgaccgtgatggttaacgtgctaggcgccccacaaccgccgacgctgagtgtagtgactatggatgaacggctacaccacctgtttgcgcggatgcccgatgctcgggttcatctttacgacaaggttgagcgtcctggtcgcaaggttgggcacatcaattttcgcggcaccgataaagaccgaaaaaaccccactaagctgcgtgaacgcgctgagttggcagcgcattggctatcacacgggcagtggacggatggatgggatccacaccgtgccggcgacgatgtagtggagatatctctcgcttgcggaggacgaaacgatgcgcagaggcagcgctgatgaccaggcagccccgagtcggggtgatcatgggcagcgacagcgactggtcggtgatgcaagatgcggcccatgcactggcggagtttgacatcccgatcgaggttcgggtggtgtcggcgcatcgcacccctgctgagatgttcgactatgcgcgcaatgctgtcgaccgcagcatcgcggtgatcattgccggcgccggcggcgcagctcacctgcctggaatggtcgcttccgcgactccgctgccggtgatcggggtgccggtgccgctggccaggctcgacggcctggactcgctgctgtcgatcgtgcagatgccagcgggagttccggttgccacagtgtctatcggtggtgcccgcaacgcgggtttgttggcggtgcgtattttgggatcgtcggacctgcagcttcgagcgcagctggtcgcgttccaggaccggttggccgataccgtgcgggccaaggatgcggatttacagcggtttcgaggtaagttaatcggcgactaatgtctgactctctccccgcacgcgggtggggatggtcccaccgcagaccgcaagtaatccgtccgcatcatggtcaggttagaaggaggcagtgatggttgggtggtccggaaacccattgtttgatctattcaagctgccagaagaacacaacgaattgcgggcaaccatccgcgcgttggcggaaaaagagatcgctccgcatgccgctgatgtggaccagcgtgctcgatttcccgaggaagcgctggcagccctgaatgcatcaggtttcaacgctatccacgttcccgaggagtatggtggtcagggtgcggattcggtagcggcttgcattgtgatcgaagaagtggcgcgtgtcgatgcttctgcatcgttgattcctgcagttaacaagcttggcaccatgggactcatcctgcgcggttcggaagagctcaagaaacaggttctgccatcgttggctgcggagggggcgatggcgtcctatgcattaagtgagcgcgaagccggcagtgacgctgcgtcgatgcggacccgggccaaagctgacggggatgactggattctcaatggcttcaagtgctggattaccaacggtggcaagtcgacctggtacacggttatggcggtgaccgatccggacaagggcgccaacggcatctcggcgttcatcgtgcacaaggacgatgagggattcagcattggcccgaaagaaaagaagctcgggatcaaggggtcaccaaccaccgaactctacttcgataaatgtcgcatccccggtgatcgcatcattggtgagcccggtactggctttaagacagcgctagccacgttggatcacacgcgtcccacgattggtgcccaagccgtgggcattgcgcagggcgcgttggacgctgccatcgtttataccaaggaccgcaagcaattcggcgagtcgattagcactttccagtccattcagttcatgctcgccgacatggcgatgaaagtggaggctgcacggttaattgtctacgctgccgctgcccgtgctgaacgcggtgagccggatctgggctttatttcagcggcgtcgaaatgctttgcttccgacattgcgatggaggtcaccaccgacgctgtgcaattgtttggcggcgcgggctacacttccgacttccccgtcgagcggttcatgcgcgacgccaagatcacacagatctatgaggggaccaatcagattcagcgtgtggtgatgtcgcgggcgctgctgcgctgatccggggtgcgttgggccggcgaaatcgcttgctcgacaagcagtcaccactagggcgaacatgtgcaaccctgtggcgtcacaaccggggttacccatcgttagtcttgaactgccggctagcttgtccgatgctggcatgtgtcgcgctggctgaccggttggccacgggttctgataaaatagtaagacggtacggtactgggctgtagtgcttgcacgggtctatggttagcggtgtaaccgcgattcggtcgtgtagatcccagccaacaggttcccccatactacctaccagtacgatcctgaaagccacgacaacggtaccgatgatgacgttgctcaggctaccgcagtcgccctgtgcccagtactctaccagtagtacaaatactgtaaaagcacggttgacaactccgatcagcattcagaacgttgcgggcgatggtgatcgttaaccgtagcactgcttgctttgggcgtgtctttcccaggatatcagatgcctcgtcccactggttagtccggtattccattctcggcgtaccagctcacgcgcggccacatttgtcagcagtgcgatcaccgtcaacaccagagaaacctaggtgagcgtcattactgctaagttgatggagttagccagtgtcgaatccagctggcagataacggtagcggcgatagtggtcatactcgaatagatgttggtgagcattgcccttcactccgtaccggataccattgcgatggccatggttttcctcggcgcgcgcctaagtccgagaaccacggcactgacgatgccgctggacacccacggcaagttgatttggtgcgcgccattccccagtccgggcattttcaacctcacggggcaggaggggaacctgtataaccaagttacgggtggtgctggctggcgatggtaggaatgaccataaccaccagcactaggatgggaacaaatatgtcttcttcgttaccggtattgctgtagaaatagttgagcaccggcacatccggagcgttgtgggcgaacaccggagcggtatggtgagcgatgaacggcccgaatgtcagcgctcccacaggccgacgacaacgctggggatgtcggcgagaaattcgagtaccatgctgagggttgaggcgagacgtttcggtaactgttcggcggtcgtcacacccgctctgatgaacaccggcaccgtggtggttaaggtgatcgcagggctgcccagggtgccgaaaatcggcggtcatgctccgtagtgagcgccgatcgtatgtgcaacatcgtggctggcgacggtgttgcccggattccattaagtggccgtgaagaaatgtaaccctttgaacttgatcaccggcagtgccttgataaccaacgccgcccgcacgaacacgaacgctagcatcgggatcaccgcaaccacatcgccggtccaccggatggcgaggccggtgcggctgaagttacgaaactggcttaggccggtccgcggtatgtccatgcggcccggcctaacctgaggccggaaagaccagtaaagggttatctaaaactctttaattggcgatttgtgcgtcggacaaattggccaccggctccggtagcggctgagagtgaacctggttggtccaggaaaggggtgctgttactgttggtcaccgtccagtgcaggaatccctacaacgtctgtgctatggcggtattttttatctgctgttgacgctggcgtactagtagttgacgaacaggtgcctggggtagcggtcggcccgtcgatcaggtgaataaccttgctgcgccggggtgtgcgaggcgaagctggctgtggcagcctgaatactttgggcgtcgaacagcagttagttacaggagacattgcccgattggctctcgcaccgccccttctagttggtgtggtcgaggaagtcgatgccgcctgtaggcgacgcagctggtaactatgccaccgttgctgttttgcccagtgtgcccggaacgatggggaagtcggcggtcgtgccgaagccaggcgacttatcccccagccgtcggggtcttgcttggcaagataatgggtgaacaaatgaaccaataaggtgttatcggacccgtcggaaaggtgcagtggaacgacagtggttcccggcaggttcacacccgggttgagagcggtgatttgcgggtcgttccaagttttgatcgtgccctgggtggctgctgcgccagcaccttgccattcagtttgaggtgctcgttgatgccggacagattgtagttgattcgctgagcggaggtggctaacgcgatgttcatcaatcttgtgtgcgttgctatgtcgccctacggtggggtacgcgtcggagacgccgatgtcgaccgtcccggcagcggcttgcgcgatcccggtaccctgggtggtgatcgtgacgtttgggtatttacttcgtagtaggtatgaaccccatagattgaacagggggttaatcagtgtgcttccggtctttgacaacgtgaccttcgacgtcgccgtcgcggtggtgacttttaccgccggctccgatactggatgaaccacttgttgagttcgaaccgcagctgccaccaaaagaccagcagcacagcagccaactacgtacgcaaacggatcatcacacaattgacttttctattgtcggtccattccgggtttctgccatttgcttctgtggtcccgatttgcctttatctggtaccgaggagcctgcggtcgctgaatagcccggagatgtaccagaacgtttcggcatgtttgggttacaggaacagttgttcggtgggtccttacgcgatcagtctgacgtagaaaatgatgccgtacggtgaccaatttgagtggtctgactttgatcatgggtcaccatgatcaaagtcagaccggttggccagtgaccgaatgggctactcgatcttttcggtcatggtcgggtccagcgaagaagtgggcttttcaagcaacaccacttccggccccaccgcaagtgcacggaccggacacaacaactgctgctgaccgccggaaagccggaacggcgaatcacctagctgctccttgaccgcatcccagagccccacttcggccagtcgagcttaagtaatgcttatgaatttttgcgcgacaccatcttttgttagcgtgcacgttggcaaccatgttgtccatgatcgacttgggaaacggattgggacgctggaacggcatgccgactaggctgcgaaactccaacaggtcgccgctgttgaagatgttttgtccgcctagcaggacgtcatcgctgtaccggtatccagatacctttgtcattcattcgcttcagagtgcgtagcacagttgtcttccctgagccggtcggctccagcaaggacgtaaccgcgcgggagggaaaatccaggctcacttagtcgagcacggttttggcggcgaaattcaacgttagattcaccgcagccatgacaagtggagcagcattagttttcggggtaccgatttgggtgccgagctgttcaggactcatcaacatcccaccaaaaccacttcgagaccccacgcaagttgtcatgcggggctatcttctatgtatccttaagggttccgatcagtatttgcttatctacgttgctgcggctaaattcttttagattccccaagaaagcttcaaaagcgcctctaatcctgcttccaactggcaaggcgtgtatatccataggtccgtgtgtttgtcgccaaaccagcgtgcggcgagagcattccagggggtttcacggtggcggaatgagtgcgtttgtcttctgactcgtgaaaggagttccgcgaagttcacctgctctggcgctgcgctgcgtctgttggccgccaccgtgctggtgttatcagcgtggcgggggcaacatcgccaacacctcgtcatctggatcctgcaccccgtcggtgccggtgcactgcggcggcatgaaagcagcttaaggacgccggctcgtccgcccaagagaacgctatggaacaatttccctattttatatctgggcgttcctgggctgcacgttggactacaacaacgcaaacggctccggcagtggggttacggagtgcatcaatagcgaaaccgatatggcggggtctgacgtgccgttcgatccattgataggtaaaccccagatcgcggcggcgcgctgcggtttgccggcgtgggacctgccgacggtgtttggcccgagcgcggtcatctatcacattaacggcgtaacttcgttgaagatagacgggcccgccacggcaaagatctccaatggcaccttcaccacgtggaacgacccggcgatcaccgcgctcaacggggcaccccgctcccgtctgatacctagccacgtcatcttccgcaccgacaagttcggaaccacatataatttacctcgattccgcatccaatggtccgtgaggcaagggggtcggcgagacgttcaatgggggtgccggcgcagcggggaacagtagcacgtcggcggcccctgcagagcatcgacgggtcgatcgcctacaccggatgatcgtttgcggtaggcaagcagttggatatggcccagatcatcacgtcagagggtccggatccgatctcgattactatcgactccgtcggcaagaccgttgcacgggccaggatcctggggcagggtgatgacttggtgtttgaacacgtaatccgttctacgagccagcgcggtatagtgcgtacctgattacgccggcgatctgtgagatcttctacttgaagtatctggatttggccaccggcactgcggtgaaagtgtttatttagttaccaatttggtatggattagactctataatagggcgattccattgccgagttcgttccaatctaacctggcggcagcggtgaatgctatcgcataactcccgtgcccgggcgagattctttgacgtgccggacatcggccatcgccaccaattcctcagggctctagtggctttggatggttcttcgacgacacccagaggacacctcgtgttgcgcagtttgttcctgtgtcccggtgactatggatttaccttgtggtataatcgttttcgatgtgggaggctaaggaagggcgtcgggattggtggccaattgaggggagcaccgacggtgagtgaaactatttcgcgggtaaggtcgctgtctatgcagaagagaacacacgcacgcgccgggtggtggcattgaagctggtttcagcttaatatttaagcgattcggagttttgcgcgtagatgcggtgcgaggctgacatgggtggggttttttactgggctgcactcctgcctatccatgactaaggtgatcaacacgcagttctatgtggagatgcgtctcatcgacagcgtttcgctgcgtaccgcgttgtcacagtaaggcttgttaagcccggcacgtacgggtggcctatcgtgtcccaagtcgcggttgcgctggaggcctcatacgcgacggtgtcatacaccgcgacgtcaaaccgggaaacatcatggtaggtcagcaaggacttcgcttatttggtggatttcgggatcgcgcgctgtttctgacccagagcgggactgagattggtacctacaactatgtggccctggagtggttcaccggcaacgggcttaccggccgtgctgatatctagatgctggtttgcgtgttgggcgagtgtttggtcggggcgttgctttattgtgccgaaactgtccaaaggatggttgctccgcatctgctcgagtctgcaccgtggcccggcagactgcgaccgggaatggttccagcgacgttcgacgacatgattactaaaggcgtggccgaaaactccgtaaaacgctacactactgtcgggtatctaggacgaagtccgccagctagccgttgactgccccccgggcagcaggaagccacaattcttcagcacggagacaacgcggccatgttgggcaatgccggctgggcccattacccaggccctagcactgctccaaggtcaatggtgtcatcagagcggttgcccggcgaggcgactgtggctcgttcggcaaccaccgacattggcgctggcagctggcgtccacctgggccgccgtgctccgtcagtcctgttgacccaccaagtttagtcaaccacccgtcgtgcccgtaccaggcttgaatcccggtgttgcaaaagcacgcggtggatctttgccggcgctgttgtgctcgtgctagttgccgccatctgtgcaacacgcaggtcctgagatcgcgcctctagtcgcgcagtctgggcaggaaatcgggcaaaccggtgctgtagtgcaatggcatcgactttcgactgtcttcaagcgggggttgacgtcagaaaaaacggcgacgtgtgtatgtcaccagtgaaggcatgcataggtgggtggtggagttggttccggagtccagtaccccaacggtgttgccgttttcgcttctctatcagccttagacactggcggtggacgtcgcccacaagcgaatttatgtcaccgacaccgagcacaaccgggtgttggatactcaacgtcgcgacaaacacccagaccatgctgccactgagcggcctcaacacccccttggtagtcgcggtggacaaaacgggagttctgtgtcgccgaccgcgacaacgaccaggtcgtcaaattgactccctaactctactaatcgctgtgtggtccagttagaggcacgtcgttgtgctggccagcaacccgatggtggatttagtgaccgcggcgttgaagctggagtagcgggccggtgtgtggatcacttgtgatggctccaatctgcggctaccgctgccgacgtgcagggcggggtcgttctctgcgaacaacggagtgtcgacgacttgtttccatgtgtgggctaggtgggctatcagaccgccctgctgaggcaactcaacccactcgacggttaccttggtggtcagggtcgtctgaagttcgttggccaactcagcgtagttgaccgccctcgtgcgttggtcgctgaatcgcttgtcgtcaacgatatcggtttgactgatggtgctacacaactttttccagtgtttaggaacatacacgctgattacgacctacctatcgaaggacaggaaggcgtccgacggttgggtgtaaaatctaaatatttgctctgcttaatttttggatcattaccagaagctggcttggcggttatctgggtgtcgtccgcattgtttagatgcattgttagctgtttggtttgtaggactaccgcgacgttgtacatcgcgactcgcgacgatgtccgaaaactcgtggcgctcgcggttgagcagcgccgacagcgctgcctgggccagcacgtgaccgctggcgttgtcgacgagttggaacaggatgatctgcggtttgctgtccggtgtgggcatcccggtggggatgctggcctcggcggtgagcataatatcgacgcctggtcggtttccatgtggaccgttgccactgaacaccgttaagtgcgcgtagatcagcttgggattgcgttaccgcaagtcgttgatttccaagactattcgctctatagccccagagagaaacctcctagaacgagtcggtagtgtcggtgagctgcggtatctgttgtctggcctcgtcgttggtcagggcgacagttactgatttattgact

SEQ ID NO: 122 - DNA (genomic), 41171 bp, MYCOBACTERIUM LEPRAE; double-stranded, circular
  hypothetical: NO
  anti-sense: NO
tccagaaggtgcttggtcacggccacattgcaaaagtcgtccgcgcgcacctctaccgacgttcagcgattacgaagtcagcgagctcatccttagttggctatcggcacgccaccaatccagcggccgagtcagaacatctcatcccgggagcacggtaccctcaccccgccagccgtgtgcgttgagccaatccacgacaaaccgctcagtcccggtcgtggtacgtcataaatacttaactactgcaagaagatatacgcgctgcccgatgacgagttcatatgccgccctcccgcaccgatcccggagccgcacgcaggggtcgcggatcagtctggtcaggttcgaacggctcggtccaccatcaccacaggtaacagtgaggtcgacactggcctatgatatcctaggtatcgtcatcgcatgctcaatgtgttccctctaagatccaaggtgtcaagtgctccctctgttccaattgcgagtcggtggtcggccctagatcgacatgccagagtgcctctgaccattaagtcatccaccgcttgagcgactatctgtgacatcagcagccttttacttctgtcggctgccgatcaatgtcacaacgtggtcgccaaccaacagctgcgacaactagttcgcttctattatgtcgagaccaacaaaattcatcgcgtgacttggaagacatggaatgaccatgcttgttagcaaaaaatctttgttagcaaacaatcagcgtgaagtatggttattcgaaagccttaccccgggcttgtggcgcagcctctggcatcgactaacaccgttggccgcttctcggtgcatggggcagccgcttcttcaaaattgctggtatgcaatgctataaagagctgtgccaggctctcgctttgcatgtgcttatccagactggcggcatccaagccaccccacaaagcccgcttcgtcaactcagttccagaccgcgagaacgtcgccatccgcgcggcgatggagtagcaagtgtccagaagccgatcgtccgacacccgatatgacaccagcccgatctgctcggcttcctccgccccgacatcgcgaccgctaagcatgatttcaaaagcccgcgacgatccgacggcccgaggcagcaaatagctcagccccagctcactggcactaaggccgttgttgatgccagcagctcgaaagtaggccctagttgaagccacccggacgtctgcggccaacgccagacacaacccaccgccgatggccggaccattgatcgcggcgatcacaggttggtgcaatcgccgcagagccaggatgacttcttcaagaagctccatggcacgcaacgcgcgaaccggctgtgtcaacccctcgacctgtggcacaggtgccgtgaacttttgatctgcaccagagcagaatcctcgacccgcgccagtaagcacgaccaccctcaccgagtggtcataggtaatccttttgagaacctgcttgagcgacttcataaggtcgagagccatggaattcatccggccgggccgattaagagtgatcaacgcgacctcaggtcgcggaaaatccagcacgaccaagtccgtgacggatctatagggaagctctgcaatagtgcacgatgcatcagtctgactcacacgaacagcttgcagccattataaccggaaaacatcggctgaaacgcgtataaatgcgaaaaacaacacgtatatggtgcaaaaggactacagtaaagttactataagaagcagcgcctgcgcaccttgtcccgatgaattgaagtgatgagatccgaaacacgaagcgctagcgggtgtgcgaccgtcctggtgactaacctacctgccaacacctggtgctcaacgcgctccccgcatcgcacaacatgatcggaactgtccaaggacctagctagcacaggttacaggccgtctcagaggctatgcgcggaccgctagtacacaccgtaaagccttgatacgcggtgtctaaagtcatgatagttgcacttgtggtgagcgccaacttgtcaccgactgcatattaagaccgtgctgtagcggtgaggcgttagccggattggctggacggtaacgacaacgtcgttaccgagcccacgctgaatcgcccaacctctcctcccaccaccctgcagcgggcatcgttggccagcttaggtcggcccggtggcaggctattgggcactgcgcccgaacatcgggaatatctgacattaagtggtgttcgagtcggtcacacacacactcggcgtgagcaatggcaggcgcaccagcgtcttgtccggctaaggctccgatgccccaccgccggaaaatcgacgctactgggattgatcaccaacaccgttgcacctgactccgggcgcgtcaagcacggcaagaccgtccggctaacggcgctcgatcagcagagcgatcagttggcaccgttggcacacaaccggatcaccgaggtattgaacagactacgcggcggctgtccaatcgagggtcgtgcaatcccccggtccagctgttggagcgactcggcttcgtccgcgaggcagttgtccgcgcaaatagctggactctccggcagccagctggcagcagttgcagctaatgctcaccttgttatccgagccggacgtactgtttctcgacgagtccaccaacgacgtcgataccaacacgctgaccgcgactgaggacttcctaatctcctgggcagtcaccttgtcccgcataactgggtacttactacactcggctaccgagaagcagctgacgtcgatcgatcgcccatccgctcgcctccctaaaccagatcgcgatcgcggctaaaaacactccgaacttgtcgagcatgcccaatacgaccacgtcgccgtgacgtagctgacacgggagctacgcgcgcatttgagaacgaggtcgccacgagggaaagtcgctgctcgcctgaccttttctagaaagggtcaattagcggcagcgttcgcacaagcgggtgacacagatgtattcggagcagccgtggccaccacttcgatgaccgtgatactcgcccgactggcttccagaaccaggttgcatttgctcgctcattacactcaccgggttcgggcacgtaacttcgctgcgttaatcccctgactgagcctgaccgttgaggtcatcaactcaatgccaacgcagtagcacaaattctgcgcagaatccgaaacccatcccgaccatcagccctgagttcccgttgggtagcggtttggcgatggtgtcgcgcaataatgtgcggtattgacaccaaccagaggttgaccgatctcgctcaatgagcaccaggtcaactcaagagcctcgggaggcaattcaagagtctcatagtgatcgcatagatgacccttggccaccaggatggctaaacccacacaccaatatcgttcttgatcaaaccatgcgctacgaggaagccaatgacgtcatcggctcggtgtcattcgacaatactcgtcagctccggtcggagacagtaccagcgacaagctggcataattgactattcaagcccatgatgtgcagcgattccggggtagagacggctgcgcgaatcgcggatgtccggcacactggcacagatctgtccgtcttcggtgcggcgctcgccgaacagaaccgtctccacaccaagcccgacacagttggtttgaccgcggaataggtgagcgagcagaccaaataccaataccgcgacatcgttgggagcaccacacaatatcttcatgcaaccggcccaaaccccgctgccccgtcacacaccccaagccgaacagaggcattcggcggacatccaggcgcagaccgagctgttcagcgcatctagcatccagcgaaggtactgcgaagccggtgatcgtcgtggtgacgatcgtgtcgacatcttggtgttcccaagcctgtctcatcaagcgctcctctagcgcatcataaccaaattccactgcgtttgcgatgaaaatctcgttcgcctagctgaagtcggtcagctaggcgtaacttcacttttccagcaacagcatcagatttcgactgttgaccttcgtgccggcatgcatacgtcgaactatctgctcgtactctttcaatccagaaattgaacaaaagaatcggtaacctcgctctggctatatcgatgcggtggaaacatactgaatacacctgcgatgacactcatatcctgcctctgtagtcaccactatcaatactttccaacatcccatctgtatcgcagaataggattccacaaaccctgaaattttagatgtcttttgcagtcgtgcaaaaaaccacttattcaacatctgttgcatttacaattattagcattgattaattaagatcgcttcacgatttgagcatccaagctaaccaaccatagcggcagatatcgccccctctacccacccgcacactggccacataggcttagccaaatgctaaacaaaatcgttacaattcactcgatttccgccacaaatacgaagcctggacagcccttttcgtagtcacaaaaacaatatttaacatccgttatatttcaaccggtactgtgcctaattgtacgtaccaaatacgatttgatcaatggctgtcgtcgactggttttatcgtcatcgcaatcaactcttcggcacttaacgagtcgatgctatcgtcactgacagctggctccaaccagagactttcctagactacctgccaccagtaacagtttgtccagccatccggcgttacgcagctcgcgtatagaaatctttcgcagcagaaaccatcttctctcgtcggattgttcgcggtaaatgctagacagttgctaaccaaggtaatcggccaggcccgctggagtgggacagtcgaagagcagagcagaatgcgcaaaagcgctaatctgcccagcccggttacggctttgagatggtcacgcagttcaccccagtcagtaactcaaatccgaagccttgaaacgcacgctgagcatcaatgtcccagcttcccgagtgatcccagataattgccgtatgcatacacaccggttcaaccaagtaacggtgcagttcttgcggagcaaattattgcaacaactgagctgcaccggtgttagtatgacccaccccacaccctccctgtatcttagcaaaatggctgctgcacaaatgcatacgttggcaacgtctaccctgcagacccccaaacccttcaaacatcacaccccaattcagccgcgcatccgcagtgaacaaccacccagtgcgccgaacgcagaatccacttacggtagatccttagccaacaccgccaccgaagcggcacgctcaccgaacaacgactgttccaccgccacggtcaaccccacaccggatcccacccaacaacctcgcgaacccacaaagactccaccgaccccacactgtcggcaaagcgcaccggacgacacgcatgttccacccaacatactgcgctaaccgctgacctaatatccatccctaggcaacttcccagtcatatttgataccaaaccaatccgtgactcggccatcgacacctgatccagcatccgggaaaactccttcaccatcgtttccatcagcaccgcatgaaacacatgcgaaaccaccaacctatgcacccagcgaccctggcccaccaaccgatccaacagtgcgcccactgcgacctgcagcaccgaaataaccaccgcatcagacccattgacaatcgcgataccccctatcgaacaacggcgcaatctccgcctcattggcggccaccgcaaatatcaaccgaacccgagctatcgccgccgcatccccagctataacatccccgcttcatacgtcatgctgatctaccctacatgaatgaccgtacgcaaaatcggacaccacaccgcagccttgcaacaaagcagccaaagccaaatctccacggtaaacaaagccggctgggcaaactcaggattttccaacagaaccgcatccttatcccaattcttctaccgcaaaggcaatcgcagatgcggatccaagacgtcggcagcgtcatcaaaatagttagcaaaaacaaaaaatcgttgataaaaattgctgctcctctccccaaacactgggaattctacctgggaaacacaaaagccatcttgcctaacgaatagtcttgttctacaagaacatccacgactagctcactggaaatcaaccccgccagctctgtaaacaaatatccaagatcaacccctcacggtaccagccgaggctcgaacaccgaccacgtcgtcaccaacgagaaactgacacccgcaatatcgaacgtaggttgctgacccacgcccgccaacaaccgttcctccgtatctgccaacgctgcgtcgaacgacgcgaacaccacacaaggaagggtgaccacatcgttatccagttaagcaacaacactttccgctacaattggtgcttatctagaaaaacaagcgcgctagtaccacccgttccgaacaatgatactcctgcccagaacaactcactgtgcaccgatcacggtgtcacggtcgtgtcgacgcgcagtcctagactttccagatccgatgccatgaccggtgtccgcgaagttgaaatttgatggaatcaatacgctattcgatcgacaggacgatcttgatcaggccagtgatttcggctgctccaccagcgtagccaatgtcaatcttcattgaagctacacgtactggacggtcctggcaatcggtgactatttcctctggtacccttgcctagatcgagtagccaattttgatgccgactacgtgctcctcaacctagtggacttcagtgctatccatgccggtaatgcacagtgcactccgtatcacacgacttgtcctgaaacggacggaacggtcaaccctgcgacggctgtgccggcattgccaaccgcgctgccacgaatgatcgcatggattctatcgccatcgtcaacggcaataagtaacaacttcagcagaaaccacccgccaccttcactctgtaaaggtacatatccatccgagcgcccaacaaacgcttagatgtggccagacaccgaaaatgccccaaactcctttttcaataacacggtttcgctcgccaggttgagagggatgccaccggagaaccgctagcggcgacgcaccggttcgtagacttccacaggtgaggtaaaccgccaccagagaagatgattgactggaatcaacggtcaccctggtgccgcccatcccgaagaaatacgacaccctgttggcaatcagccctcgactggtgctagctaaagagtcagaagcaacgttaaccgcaacaaacgtcaggaatgcgtaatcgtcgttaatcgctccgagaggagaccgcgacctgttgtcctagtatcgtttttggcacgacgaacgcgtcctcaagtagttccccatatcaacttgagcaccaatcgctacctagggtccatcgcactcgcctagcgtggcgataagaagttggcatcaaaattgaccacgttgtcaactgccgattgcgtgacttcacgtccgtcgcgcacgacacaccagaagtcgcgcgggctggccggcaaccggggaatcggcacgacgataatcgccacgtcgtcagacatttacgggctaagttccgcgtcgagtatgacgaacagttggctttcagtgaccctttcagtgacctttgtgatgtcgtcgatacccaaatgattggggaagctccgaattcaactcacgttccagcaccaccttggtcaatttcgttgaccaacccatccgcgccggcgaagctacgccctaacacgcccttactatgggttcttctgccggggcatttggtagacacccctgcttccccaggtgcgtatatttagaggctacccgccggccaagtcgtctgatgcgacagccacaccgctagacctgaccatcatggcaacaacacctgccatcaaaccctgccggctatcaaaccctccaccaatatgattgctgcagatttgctttcaaacgccccctacatatatctataatagctaaatagatatagcgtcagcactgtaccaccccgacggcggttatcagaagcgttaggactacatctacaggcagttggcatcgggcgcctgtccgatttaaatccatccgagacagtcgaaacgagctacgcacggtcgcaccccaaacctagatgtcgtttggtccgggcttagtgttatcagattactcacggcgaaccagctccatttggatgcgatcaacctcatcctgaatattattagagtagagaaacgttgagcccccgaggcgacgacacgctagcccgaggcggcaaacaaggcgccctaaattaagcatttaagagacgccgccgctaacactccggtgcaggatcaccgccagttaccacgtcgtcaagaccagttacttcttaatagacaccatcgtccacaccgcaaagttcgctgaggccggtgacgtggacctgttcatcgaccgcaccagccaaacgagcccgcaccagcaaagcatccgatttaccttcgctggtctaaacacgcctatgccaccgcatgcctaaacatctcccctgtacccgatcgcaattggtcacgtgacatcagtgacgaaaaacgcaactgccttaattatcttttagcgcccagctgtcaacccgcatcagactaggttggcgagcgattctggtgagtcgcgattcggtgcacaaccgtctttccgtctcatccgccccacaccaggcgtccagccgatcccaactgaggcggtaacctaaagcccatgcaaaactcgtccgtcctttctttcctgcgcgaacgtgccggcctgcagccagacgatgaagcattcagcttcaccgactacgagcaggattgggcgggtgtccgcaaaacactgacttgggcgcagctgtatcaacgaaccttgaacgttgcgcacgagctcaggcggcacggttcgataagagaccgggcagtgatattggctccccaggggctggactatatcatcgcgttcctgggagctatgcaggctggctttatcgccgttccgctgtcagtacctcaggccggctcccatgacgaacgtgtcggagctgtgcttgccgacacatcaccctcggtcgtcctgacaacgtctgcggttgccgatgcgatcgcgaaatacgttgaccactctgacaccgacaccgtcccggcgatcctcgaagtcgactcaccaaatctagacgtcgagaataaatcgaatattagactcaccgatgcgccgagcacagcgtacttacagtacacctcgggttcgacccgccttccaaccggggtcatggtcacgcaccggaaccttatggtgaatttccaacagttgatggctgactacttcgctcccactaacggtgtggcgccactcgatctcaccatcgtgtcgtggctgccgttctaccacgatatgggcttggttctcggcgtcgtcgcaccaattctgggcggctggcggagcgagcttacgagtccgatctcgtttttgcaacgtccagccaggtggatccaagcgatggccaccagcagccacccattttctgcaggaccgaacttcgccttcgaattggctgcacgccggacatcagacgcagatatagccggcctcgatctcggcgcttgccagggcatcatcagcggcagtgaacgaatccaccccgccacgctaaatcggttctcggatcggtttgcccgaatcaatttccgcgacgacatgatgctaccctcctacgggttagctgaaggaactgtctatgccgccagcgccctaagggaagctcgccagaggtcgtttatttcgaaccgcgaagctgtcggaaggcaccgtgaaacggcgaagcacggaccggcgcgccactgctgagctacggcacgccgaagtcaccaatagtgcgaatcgtggattccgacacgtgcatcgagtgcccaacaggaagggtaggcgaaatctggctacatggtgacaacgtcgccgaaggctattggcacaaaccggaggaaacgcaacgtaccttcggcggaaagctagctaacccctcgccaggcacacccgagggaccgtggttgagaaccggagacctcgggtttatctccgaggatgagctgttcatcgtgggccgtatgaaagatctgctgatcgtgtatggacgcaaccactaccctgaagacatcgaatcgacggtccaggaaatcaccggtggtcgggtcgcggcgatatccgtcccggttgatgagaccgaaaaattggtcaccattatcgaagtcaaaaagcgcggcgactccgacgcggaagcgatgcagaagctcgtcgccgtcaaaaacaacatcaccgcggctatatccaagtcacatggtctgaacgtagccgacctcgttctggtaccgccggggtcaattcctaccacgaccagcggcaaggttaggcggaccgcctgtgtcgagcagtataggcggcagcagttctcccggttagacggctaaatcacactagctggcaaccacgaattgccatgtggatcacaatcctattgatggccatcgcaataagcctcgagccattccggatcggcatgacggtactgatgttgaacagacccagaccgacgctgcaactgcttgtattcctgtgcagcggattcacaatggggatgaccgtaggtttcgttgtgttgttcgtctttcgacgcagactcatggcctcaatgcaattgacgttgcccaaggtgcaaattctgatcggtgtgctagctttgctggtagctgccgtattgacggtacaggtctgcatcagtagcgaaccgccagcggaatctcccgtcgacagtgcttctggcccaccgaagccgtcaaagtgggcaccaagacctctagcaagactgctgaacggggattcgctctgggtcgcaggcgtggccggcctggggatcgcgctgccttctgtggactatttggccgcacttgccgtcattttgacctccggcgctgcagccacaacgcaagtcggtgcactgctgatgttcaacgtcgtagctttcgcgctgatagagatcccactcgccgcctacctgttggcacccgacacgacacgggcatggacggcggctctgaacaactggatccgttcacgccgccgtctcgaagttgctactctgctagccggagtcagctgcctcctgctcgcagtcggcatagctggtctgtgagtggatgtccaacttgctgtgtggcaaccggcagccattgcaggtaccataaactagtgaagacgtgcttgcgtcgcggctcggcgccattgcggcgcgaaaatcactaccatcactcggatgcatagccccaacgggttactcggagaataagaataacgagatgaaacgactactggctacgaccctcgccgccttgaccgtgggtacggttagtggatttggatccaccgtcgcatcaagcgaacccggggagccatggctgccacccagcccggttccggtgcgtgagaactcacccgccaaaatcgtctatgcgctaggcggcgcgagaccaccgacctttgactgggattactacaccatccgggccggcgacgagtttttcccggacgtcaaccgcaaactcatcgactaccccgccagagccccttttcgctatgtgccaacatttctggtaccggggcctcgagacgaagtgactatcggcgaagcgattgccgtagcaaccaaaaacctaaaccaagccattcaccgggggaccgagccggccgctgtcgtcggtttgtcccagggtagccttgccctcgacacagaacaggaacagctcgccactgacccgacggcaccaccaccagaccagttaacgttcaacaccttcggtgacccctcaggataccacggattcggcaagagtgtgcttgccagcatcttccggcccggggactatatcccgctgatcgactacacgatgccccagcgtatggacagccagtacgacagcaacagagttgtcgccgcatacgatgggctgtccgaatttcctgaccgggcagacaacctgttagcccagttgaattgcttcgctgggggagcaatctcgcacactccatccggattcttcaatcctgaagatgtgcccccgcagaacatcaggaccactgttaactcgcggggcgccaaaacaacgacgtatttaattccggtgaatcatcttccgttgacgttgccactgcgctacctcggctggtccgacgctttggtggatcaaatcgatgcggtgctacagccgaaaatcgatgccgcgtatgcgtacaacgataatcccttaaacaagccgatttccgtagatcctgtgaacggcatggacccgatcgccggcatcgacgcggagctccgcgacagcatcctgaatgttttcgcccagctccgctcgatccttccaccgcccccgggttgacctgagtagttttcaggcaacgcacaccacagcatcacagcatcgtcaagttgttaagaggaacggatgcttggtccacgatgtcgcgtggttagctacgaaacgaccagctcttctcttgttgtgccaagttcaaatcagtaaaccaggatccaaaaactactgacgaaacgttcttcctcaaacgatccgaatccgaagatcttagccagagcttcggcaaggtcgagtggtggaggttcggcagcagcccagccagggtgtggttgcatggcttgaatgatttagataactttccccagccctgcctctcctcgggccacccagtctaccgaaaacaatgtagggcgccaatctaattcaagctttcagctttccggtgatgcgttgaacagggctttacttctttgtgtcaagtcgtcatcgactacgcgttgttaccccacggccgtgcgggccaccaactcgcccgtctcaacaaagcagcgaccgcaggcacggtaatagtacggacaatgaaagtgtcgagcaagatcccggacccaagcacgaagcctgcctgcacgacagtcgcgatgctggacaacagcagaccaaacatcgatgcagcgaagattaaacccgccgcggttatgactccaccggtggaacgtacggtgcgaataacgcttgcacgcaagccatgtgacgactcgtcacgcagccgtgatgcgagcaacatgttgtagtcagcacccacggcgaccagcaccacgaacgccaatcccggcacgctccaatgcaattgctgccgcaatagcacctggaacaccaagacacagagtccgagtgccgacagatacgaaacaatcaccgacccgacgaggtatattggcgcaactatcgagcgcaatagtgccataaggatcaaaagcaccacaatcatcgtgacgatgactataagctgcagatctcggtcgtagtagtctctggtgtctcgaagcgtcacggtatagcccgaaaggtagatcgacgcgtccgacaatgtggtgtttggctgagcacctgtggcgacgttgaggatcgtgttgacctgatccatggccgcactgctgaacgggttgagatcggtttgaatgaagtaccgcaccgaatggccgtctggcgagatgaatgcctggacgagtttcttaaaatcttccgtattgagcaattgcggcggcacattgaatccggccatggacggttgagatgcgtcttgacccatctccatcaaaaaggccgatgcccgggcaagactggtgcccatagtcctggtctgatcaacgagcaccgccacaccgtcggcgatccgacgtccggcgctcgcaaggtcgttgacaccgttttgcaaaccgatcatctttgagcgcataacattcggattatccagccccaaggagcgcagcgacgtattaacggcggtcagtgttttctccagaccactgaccgtggcgcctatggtctgcgaggactgcgtcgaccccaactgcttccagaggtgggcgatattgtccagagttccgtcttcagatgcggtgagcagcttgtggaactgagcgcgcgcatcggcgcagatgggattagtgtcgcaaagcacactggaatccagagcaatgaccacggcgccaacccagttgatgtcgttcatcgtggttgagaaattaatcccaaacatgttgccgagagcacgcatactcgagacaagcttgccggcagtgtcgatttcgcccaacgtcttgctgtcaccaaacatcttctgcgcgaacgccaaattgtcgagcaacccactgatccctgcgacggcctggccaacttgaatgcgtacgtcaccaagcttgtctgccaacagaccagcacccgaggccagtcggttcaagtcgccggtgctttcaccgatgagatgagatgcactgcctagctgtttaccaaccatgcccgcctgatacgtcgcactagtctcttcaagcggctttccagtgggtcgagtaaccccacggaccagagcaatgcccggaatctggctcactcgttgcgccagctcagccatatcggcaagggcacgaggcgtgcgcaggtcgtgcggcgattggatcagcaggtactccggaatcgcttgacctactgggaaatggctttccagggcagcatatccgacagagctctcatcagaggccggtatctgcttgcggtcatcgtagttgaatcgaacgaggctggcgcacagggccaacacaatcagaatgaccatgctcgcactcaagtaagccactggccggcgcactatccgcaccccggttcgccgccagaatgcgccggcgcggtcacgccgcggcgcgacccaaccacgcgtcccggcgagcaccaggagggccggcatcaaggtcaccgcagccaagaacgctaccgcgatcccaatcgccagtgccggaccgaccgtggaaaacactctgattttggtaaagctcatccctaggaaagtgatacctactgttgccgccgacgcggcgatcaccttgcctagggaaatcagtgcttgtcgcacggcgcaacccgcatcctgcgccgaaccagaccccatcctaatgtagtcgtgatacctgctgatgaggaacaccgcataatcagttcccgcaccggcgatcatcgcactgagcaacacgatcatctggttggaaacagccagaccggccagtactgagacgccagataccacggcctgcgcagtcatcaacgatgcaccgatcgtgatcaacggcaacaacatggtgatcgggttgcgatagataatcatcaaaatagttagcaacaaaacggcgatcaccagctcgatcgacgtgcgatctcgtgccccggcgtccgtcaagtcagcgacggtggacgccggccccgttaagttggccttgagagacgatccggctgtgctttccaaggtttgtttcacgatgcccgcgacgcctgcgtaggcctgataggacgcggacgtgccaagctcaccggccaggacgatcggcaggatccacgccttgccgtctttgctaaccagtaactcatgcaacggcggtgtgctgaggaaatcctgtaacaccacaacgtctttggtatcattgcgcagccgatccaccagcgtgcggtaaacggtttcgtcggccggtcctaaccccttgtcgtcggtcagcagcacgatcaatacgttttccgaatccacctcgtgaaatgcctgggagatctttttggctgcgacgctcgacggcgcatcaacaggcagaatcacgacgggatgacgctgagttagctccgtcaacgacggcaccgtcatcgggagcatcagcgcaagtagagtccagcaaccgattaccacccacggccaccgtgtgacgatgtcgcctaaccgactgaagatgagttcacccccaatagcgccgcccgggtgcaacagatatcatgcgacattacgccagtgcccactttcggcgacgcactcgaacacggacttcaacgtctccagatagcgggcgaccgactcctgggcttccggattatccggaaacatcaccgccaccgcagtctcctgctcaacccggatcacgtagatcgacatctgatacgagtaacgaccatcgctatagacgccgatattgaggccgtccaatcccgcggtaagcaataccgaaagcggcgcggttcccgcatcaagaaagttgatcactgggaagttcggccgcggcttatgcactgtcggtgccaattccaccacccggtcgtagggaacttcagctaagtgcacgtcggtgtcgaagcaattctgcgcggcgcgcgcggcatcgccgaacgatgagccagcaatagggaccgtgatcggcaccagtccggtgaaccagccttgagtcaagacatcagtcggaatgcgacgggtgtcgcgcggtgtgagcccataataggtgtcagcaccggtcaattcgtactcggccaggccgcagcaagccagcacgccaccgacaaaacgagcaccagcaactgtacatgccgcttcgaatcgatccgtctgctgctcatcgagcatggttatggtgacaatgtcggcctgagtgggctccaatggatcaccgagtggcagcgggaaatcgggaaaactgccttcgttcggctcagcgaattgggtccacgagcgaatctgtggagactccgcagtgagcatagaggtgaatcggtgctggcggcggcagaagtcatcgtagctacccgcctccggcagctcgaggggaccagcaccactgacgagtgcgctgtacatcatatggaattccatgagcgtcacgccaacgatcatcgcgtccacatggacgtggtcgatactggcatagaacgtgaaatgctcctcagcttggatcacaccgaactggaagcagccccactccagcggatctggtgtactcaccgcaagttcacgtatttgtgccagcgacagctggccatgttcgatgggcacgaattcgatgtctgcgggatcgcataacgtgtgccggatgatttcgccttcgtcggtatactcaaaccagctacggtaggtatcatggcggcgcaggtgcgcgttgacgatgtagttgatcgcacggatatcacattggccgagctggtcacagctgacaatcatcagccgtgagtagtcgagcccctttgctttctgctcgacataaccacggatgtgctgtgcttgcatgtaggcgaccggtaccgaactcaccggcgcctgcgacaccttctcgcaggtagcaggtgtcggttgccacgagatggtcttccccgctcggggtgcccaatccagcagtgtccccagtgtcaacggccctacctgcaacgtgttctccttgactcgaactccccgctatgctcccgttggggcgtctataatcccccgaagatataggccgcctgccatcaagtggcagtgactgccgattcagcttccgtagctgccagctcttcgcacaaatgctcggctagacttcgaattgtggtgattttagtgggacttatgcgtatccctgtctctgtctcgatgcgggttcgtaattccaaattcccgagcgaatccaaaccatagtcagatagcagtcgatcgggatcaatagtgcgccgcagtaacaagctgatctgctcggataccagccgtcgaatcatgctaggccattcgtctcgaggcaacactttcaattcagccaggaacttgcttttgtctttttggccttgggaaatggatcggaacgcctcggcgaagcgactgtgttgcgcaaaggacttcaaccacggcgtttccatgatcggcgcatagcaggaataaggacgattatagcgcagcagcgtctgaaatacccgagcaccctcagtgggtgcgatcgctacaccggccatttctgccaaagcggtggcaagaccaagctcaccccaagccccccaagcgatcgtggtgctggcaaggccctgtgcccggcgccaatacgagaaaccatccaaccaactgttggccgccgcatatgcgccctgacccggcgaaccgaccagcgcggcggccgttgagaacgaacagaaccaatccagcagctgcgcggtttttccttcttgcagggcctggtgtaggttccacgcgccgtagaccttaggcgcccaacaacggtcgatgaggtcatcggtgacgttggtcaacgtagcgtcctcgaccacccccgctgcgtgtagcacgccacgaaccggaagccccgattgagtcgccgccaccaccaggcggtcagcgaccctaggctcagcgatatcaccacactccacttggatatcggcgcccccggcacgcaaccgttcgatagtctcttgcgcttggggattaggcgccgagcgagagttgagtacgatccgtccgcagcccgctgcagccatctcggtgccgaggaacagccctaagccggtcagcccgccagtaacgatataggcaccgtcagcgcgaaacgtacgaacctgctccgggggaaccacagccacactggatccggtatgcggcacatccagcaacaccttgccggtgtgcccggcaccagcgactaggcggacggcattagccgtgttatgaattggatagtgcgtggtctgcggcacaggcagcacaccctcggcggtgcgttggtacacggtggtcagcaagcgccgaacggtgtctgggtgagtataagtcaacaacgccaagtcgaccgcgtacagcgaaaggttgcggcggaatgggaacaagccaagtcgggtgtcgccgtagatgtcgcgtttgccgatctcgacaaaccgcccaccgaaagccaacaattcgattccggcgcgttgcgcagcgccgggcagtgagttgagcacgacgtcaacaccgtaccccttggtgtcacgatggatctgttcggcgaactcgaggctgcgcgagtcgtagacatgctcaatacccttgtcgcgcagcagttgtcgccgctgcggactacccgccgtcgcgaagatctcacaccccgcggcacgtgcgatcgcgatcgccgcctgtccgacaccaccggtccccgaatgaatcagcactttatcggtctgtgagatccgggccagatcgtgcagaccgtaccaagcggtcgcagcgacggtaggaacagccgcggcctcttccagcggcacctcgggcgagagcgtgaccgcgtggcgggcgtcgcaaatcacaaatgtggtccagcaaccgttgcgggacacaccgccgacccggtcaccgaccttgtgatcggtgacatttaacccgactgccgacaccactccagcgaagtcgatacccaacagttggcagtaaccctcgaaagtgggataccgaccgaacgcgaccagaacgtcggcgaagttaacggtggatgcggtgaccgcgacctcgatctcccccggtcccggcggtacccgatcgaaagcaacgaattccaacgaatccaggtcacccggagtacggatctctagacgcatgccatcgtgttcgttctgcacgacaacggttcgccgttcggcctggcgcaacggaccggggcgcagtcgggctgtataccactcgccgtcccgccagccggtctcgtcctcatccgagccgctgcgcagttgccgagccacttgtgtggcgatcgtcgcttggttggtttcttcaacgtcgatctgagtgacactcaagtacgggtgttcggagtcaatcacccgtatcagcccgcgcagcccgacctgctccaggttggccaggtcacccgtcttgatgcttgcggcatttctagtcactacaaagaggcgaggccgctcaccggggagttcggagatctcgcggacgatagtgataaggtgagatacatagtccctgccgcgccgcaatgctggcgattctgccacagtggcgggtggggcggtcactacgacgacgccggtcagtcccttgagggcaccgtgaccaatggaggaactcacgccgtctctagacagcagcgaacacagctgcgcggtatcgatttgtccgagcggcaacgacaccgcggtgcaatgcccgccatcggcgtttagtgcatcgccgagttgctgaaccaacggatcctcggcggacgcgccgagcactaaccaggatccacgctcacgctgcgtcacctcaggcagttcgcgcggttcccactcaacggtaaacagccgctcgtcgagcactcgattggcacattcgtgctccgaggcgcccccagccagacgcagcccctcgaccagcaacaacaccgctccagactggtccagaacttccaagtcaacttcgcactcaccagctcgcgatgtcttgacccgggtgaggcagtattgcgcgttgcgcatcgagtggtagttaagcagtctgcgcacatatacgggcagcagcagaccgccggcgcccgccttttgcacctcgggtgcaacgatgaccgactggaagcacgcatcgagcaatgcagggtgacttgtgtatgatgcttgctgcgagcgaatggccccaggcagcgcgacctcagcaagcaccgtagagacatcctcattggtcccagcggcagtgtatactgcagtgaggcccgagaaggccaggccgtactggatgccgatggcgtcgaaggttgcccgcaaatcggcgccttccgtgcgcagcggatggctggcgattagcgcgtcgatgctgtgtgaggccggctgctgattgactcggtcctccagggcccgtaagaccgcacttgcccgccgaacacgttcgccttcctcataagtttccaccgcgaactcgaggacgccaggagccgaaaccgttgccgccgacgatgccatcgtttcacgatccaaaagcagcgtctgctcgaacttaatgtcgcggacctctgatgcttcgccaagagtcacgcgcgcggcggttaaggccatctcacagtaagcagcaccgggaaacgcggctacgtcgtggatctggtggtcgccgagccatggatgtgcctcggtgccgacccggccttgccatacatggcgctccggttcctcgaacagatgcacatgtgccccgagtagtggatgaacagcctggaccgcggcgccgtgcgcaggatggtccaccgactcgcgactcagcatcagctcccgacgggtccaggtaggtaatggtgcatccaccaggcacccattggggtactggacggagaaatcgaccaaggcgccggcgctatgcacatcggcgatgaaaccacgtaatccgaacggcagttcctgctcacgccgcatggcggccaacgcgctgaccggcatgtcgagactggcagcgttttgctcgatcgcataggtcaacagggggtgtggcgccagctccccgaagactcgaaagccatccttgagtgccgcctgcacggccgccgcgaatcgcaccgtgtagcgtaggttttccgcccagtattcaccggtgaacgacggccgctcacgagggtcccacagggtcgcggaataatacggaactttcggctcagttggtttgagatcggcaagggtttcgaccaagtcgtcaagaatcggttcgacctgcggcgtatgtgaagcgacgtcgacagctacctcacgcaccatcacgtcctgtgcctgccatgcggccaacagatgccgaatcgcctgggtgtcaccaccgacgacggtcgatgttggtgaggctacgacggccagcacaacatccgacagcccgcgaatagagagttcggaaagcacttgttggccaggtagctccactgacgccatagcgccgctgcccgcaacacgcgacatcagttgcgagcgacggcaaatgacgcgcaaaccgtcttcgcaagacagtgcgcccgcggcgacggctgccgcagcctcaccgagcgaatgtccgatgactgcccccggatacactccgtaggacttcatcgtggcagccaacgccacctggattgcgaagatcgtcggctggacccggtcaataccggttaccttctcagccaccgtcagcgcctcggtgaccgaaaaccctgattcctcgacaatcaccggttccatcgccgcgatggccgcggcgaacaccggctccttcgcgaacaactcagcgcccataccggcccactgtgacccctgcccggagaacacccacaccggtccgcggtcatcttgccccacagcggactgatacggaatctcgctgccggcgatttcacgcagtccccggctgagttcagcaaagctgctcgccaggaccatcgtccgcactggacggtatccacggcggcgcgacagcgtatagcccaaatcccacagcccagtgtgtttagtcccgctgccgtgttcgtcgacccaatccgccattcgggcagccgtcgcacgcaattgctcaaccgacgtggccgacagcggaaacaacagcgggccattgactttagatactgccggggagtccttacctgaattctctggtgcttgctcgaggatcgcgtgcacgttggtgccagacatgccatacgacgacaccgcggcacgccgtggctgctggacatcgacgggccagggcgtattaacctgcggcacaaaaagttcggtggtaatctcagccagttgatcaggcagccgagtgaagtgcaggtttttcggaaccacgccatgctgtagcgccaggattgccttcatcatccccagaggtcctgatgtcgactgcatgtggccaaagtttgtcttagtcgatgccagcgcacaacgtcccgcagttccgtaaaccgccgccaggctcgcatattcgatcggatctccgaccggggtgccggtaccgtgcgcttcgatcaggccgaccgtggtggggtcaacgccgcccacggccaacgccttgtgatatactgcgatttgtgcctgctccgatggtgctgctatgtgcacagtgtggccatcctgattagccgcggtgccgcgtagcaccgccaggattcggtcaccgtcacgctcagcgtcgggcatccgcttgagtaacagcaccacacagccctcgccagacacgaatccgtcggctgcgacatcgaaggcatggcaacgaccggtgggcgacaacattccctgcagcgaacccgaaaccgacttccgtggctccagcgtcacgacgacgccaccggcaagggccagatcgctttcgccgcaatccaaactgccgcgggcctggtgcacagccatcaagcccgacgagcacgccgtgtccaccgtgaccgccggaccgtgcaacccaagtgtgtaagccactcgcccggacgcgaagctgttactggtgccggtgaaaccgtacggtccctccgtggcaccacaatcggcggacaacagttcatagtccccatgcgtcagtcccacaaagacgccggtcgcagaccccgcgagtgtcgctgggtcaagacccgcatgctcgatggcatcccacgacgtttccagcaacaggcgatgttgcgggtcgatcgcgatggcctcacgctcagtcataccaaagaaatcgcagtcaaagccgccaacatcatccaggaaggcgccccatcgtgataccgaccggccaggcacccctggttcaggatcgtaatacaaatccgcgtcccagcgctccttgggaatctcggtcaccaggtcgtcgccacgcaacaacgcctcccaaaggcgctgcggagaatcgatcccgccgggaagccgacaagccataccaatgacagccaccggcgtaacgtttgcggctcgcaatgtgcagtcccctctatagatagctcaatggcgctcagcagtctcgccacgtaagcgcaggaaaactccgacataactgccgtaccactatgtacggcgcattcaggctaaggatcgttcgggctcaggatcgccagatgtcgcgggtggtagtttaccggcaaatagtgacaagtccgatattgacgtggcagatcccacagcggaagagtttccaacggcgaccgaacccggctacacgtcgacctgacgctaggcatatatctcagcaaggaactgctcgacggccaccgcggcgtgtaccgcccaggcatacgcgaggaatgtcgaaagcgctttgcttgcaaagtaattcgacttagaacacgggctggcaactaacctcgcgcagtcgctttgtgaagttgtgcgcctattcaacccggaccaacgagttgttacggctacatagcataaaacccgggtgcgtcttgatcgatgtgcgtgattggcgacgcgacacgaaaatcgcgcaggtggtcactgcacttcagtgtaaacacgtacttctgcgctatcggcagcataatcgtatgcatcgagttgatcagagaccagtgaagtcataaacaccgtagaacggaacaaccgcttgcacccggatgtcagccttctcgaagcccggcggaaactgtggatcgttggggattctcgtgacaacaagaaaagtaaaaagatacccatcggccgagccaccggtgatcgaaatccagtccgggttactgccctactcggcgatgtgctcctttattcacgcaatcgcgtacttgaatcaggccaggtggcacgcgggttgagccgatagttgatcaccacgtagacccaatccagctaggtcaaaaggcccatcagcgggtgtacctgtccacgtttgtttccgaccatccgagcctcccgggaacttacagcaacactggaacctgtccgtcgcggtccaagtcgggacgtcgccaaatgtcgagctggttcccggagccacactgccagtaactgacatcggcgtcatacgcataaccgcaatagatcctcaatatacgcgcaacgccgggtttcttcgggatggcaccaaccgaagcgcgggccgcttccacaagtcgcccagttcagtgctacagtcggggtcgaatcctagccacccaataccgcagtctacagcttgttggccctgtgtccgatgcggtgcagactccataaccccagccacgacagtaccgagccagctaaatcggtgtatccccgttggctggacgccgaagacctgagcggtaagcttcgagctgagcaaactgtaaccgaacacgtacgtcgagccgtaaccatgccgcgtcaaaggccgacaaccattggcggtgcacacgaaccccagcgttgaacaccaacactgctgccagttgctttcaccgtattccttggcttccccccaagtctgtcgttactgaatctgacgggctgactgatgacggctagctgggtcagtctctgtgggttcatcaatcacggaagatacgccaagtcgatcatcgacatgagacggtcaccgctctagcgggctttgctggtgacccgcgatagcggatcggactggatgtcggcacccccacgcctgggatgaaacatcacactgatctcgccggcgctgtcgcctaagacgatctgacgatccactgaagtgtgtgtgtgtgtgtgtccatgttgactaaatgtcctcggctgaactttaccagtctttccaaggtggcgcattgtccgggcaccaggccagccatattgtctatcgacaacgggcgctccgggtttgctgggtgctcataggcgtcgacatcctaaccccttgccttacgacacccgtaagtcaaccttgttgagttagcatacgacctgttcctcaaaccgttcagggtaagcctcctgaatccgagattgcacgtcataaagcactatcgccgctttagcatccgagattaggttgacggccgagcgatcttacggaacaacaacaccgtcacgttggtatcgggatgttcgtcgcacgtcttgacgaccaacatctgcgcggccccatcgactcaccggcctggacactccaccactcgtagctgaatgtcgaattcgtagtgatcccaacgctttcgcaacttctcggcgtaggtcacgtcgaccatgaaatgcaccgcgatgagatcgtcgactcgcatcttttaccgtaccacagaacttcgatcacccaaggtcaaccgagttcacgagaacaaacaactaaagtataatcatacttcaccaactcggggcagtcagtacgaaacttctcgataataacggcctaggttcgatattctgggttgagtcgcatcaacacaaacgaccagcaccgcgaataccacaacataacagccacaggcttccagtgaacttggtcaccgggaaaatccccacggggttcttacacaggaccacccatggaaaagtaatcgcccccgggttcccagtaagtcagatgatgtctggtcatcctgtaaccaggtagtggagaatccactaaacacgccgattccgggtgaacgcacatacgaagcctcgtactggtttcccaccactaccccaccgctgcttcccttgaactgcaggttgctgtcgtgttttgctgtgttgcggggtttttgttggtgggtggctgactgcctgctttcgatgaggcttcgtgtgctttgccgcagtggacacgattagcgcggcgcacgtaagcatgtcggtggtggatgctgcttggtctacatgttgatgatgccaggggctgggcacctgggctgtgctgaaggcgatatcgatgcaggcgtgagtgtgaggatagttgttagcgccgcggggtaggggcgttttagtgtgcatgtcatggccttgaggtgtcggcgtggtcaatgtggccgcacctgaacaggcacgtccccgtgcacggtataactattcgcacctgatgttatcccttgcaccatttctgccgctggtatcggtgtcggcggcttgttgaccggccctcagccagcaagcaggcatgccgccgggtgcagcagtatcgtgttagtgaacagtgcatcgatgatccggccgtcggcggcacatacggcaaccttctagcgcagatcaaccacccacaccccaccagcccaccacaacaccaccacccaaacccaaaccagcaaaaaataaccaccaaatgaccatcacgacgacaccttgaagtctaaacggacaagttactggttactggccgggcgcggcgtctggcaccaggggcatattgcgtcagtaccgccggcagcggccaaagcagcgcctgccccggacattgtgatttcggggtcggacacctcgcgccatgcgtatcacccagcctctgtaaacaccaactgcctccttgcaaaaatttttgagcgatcattcaaaaacattttttcagtatttttgtggtacaatgagatttgatcatagctgcgcacggctgcttgagacgaccgcagtattgtttcgcctctaaggattacgctccgaactcggttagccagattctagaacgtctggtgttaaacccggttcgctgtatcaccacttcccgcagggcaagcaacagttggccgccgcggtaagtggacagcgccgggatcggcaccaaacagttgctgcgtcgattactgattaccaaacggccggtggccgacattgtcgatcggtgaatcgacctacttgtggctaggctggccggtgatcagcacgacgactagtcccatcgagccgatcgccaccgaatcggtaaacgtaattttacctaatacacgcaacttatgcacgtgcatgcacaggttggcatgcgccgctcgagaatcgagcggcgtacggaagactggtcagcggcacacgcggaacagattgggctcacactgatctcggatctcgttgattgaagcagcgctgatcctctcccgaatcgctagcgattcgggagaggatcagcgcttccagacccacggcccgcacattgattgctgcgcgagtaaacctacaaatccaagccgatgtcgagaattcgcaccgagtgagtcaacgcaccgacggcgaggtaatctacgccggtccccgcgtagatcgccgcattctcgaggctcagcccaccggatgattctagcaggacggtaggtgctcggatgtctcgacgttgcaccgctacttgtgtctgccacactgggaaattgtccagcaggatcagttcgggctcctcagccagcatggcatcaagctgctcgagtgagtccacttcgacttcgcacggaagctcaggcgcagctgccctcactgcccgcagcgcgtcaaccaccgatcctacagcggcaacatggttgtccttgatcaaggcggtatcaccgagccccagtcgatggttgacaccgccgccgacacgcaccgcgtacttctgcagcgcacgcagaccaggaagcgtcttacgggtatctcggatcttggcttttgtgccacgtacggcgtcaacccaggccaccgtcacagtggctatcccggacatgtggcagaccaggttcaacatggtccgctcagccgtcaacagccctcgggctgctgcctgcacggtcagcagtggttgacctgattgcaaccgggcaccgtcctcaacgcgatagagaacccggtagccgtcgacgccgaacacctcatcgaggaccagcaacgccacatccaccccggcaatcacacccggctcgcgaggcaccatcgaccccgtgacgaccgtaccagccggcacggtggcctgcgtagtgatgtcgagcccgtaccgtagatcctcatgcagagcgcgccgaatagtgtctcgcgccgcatcgaattcgcagtcggacagcattatcaacccaccgtcgccaatgcctccgcacgcaccaagttttggtcgtcagccagtcgaatcacagtgctgcgggcgtgttctggcgcggtgtccggatactctgtgcagtggtgacaaccccgactttcattgcgggccaaggccgcagctgctactgcccgggcagtcagcgtcaacgcaacgtcttcgaaatcgcggcggccggtcacgtggcggatcggcgcctcagccagcgtgtcggacaaccgctgcagacctgcggcgttgcgcatcaccgcggcatctcggctcatcacgcgttggagttcacggcgcttcagcgcgtgatgggtgacaggctcgagcttggatacatacgcacgcccagccgccgccgcatgtcgccggcgcagcccttccggcgcggccaccgaccaccaagccttccaacaagctgttggacgccaaacggttagcaccgtgcatcccggtgcgggccacctctccagcggcgaacagcccagccagctcggtttgaccgtacgcatcggtgacgatgccaccgcagctgtagtgtgcgcccggaacaaccgggatcggttcacgggccgggtcgataccaacagtccggcatgcggcggtgacggtggggaaccgggaagcgaagccgtcgatgccgcgggcgtcgaggtagacgcacgaatcgccagtggccttcaggcgcgcgtcgatagcagcagcgacaacatcgcgcggcgccagatcacccagtggatgcacccctgatgttaccgaattacctttgctatcaagcaaaatcgcaccttcaccgcggatggcttcggttactagtggccgccgaccaccggtgccagtacccgccgcgaaaagcatggtcgggtggaattggatgaactcgagatcgctaaccgccacgccagcccacagcgccagcgcgattccgtcgccagtggacccctcaggattggtggtcgcgccgtagaggtgcccgagcccaccggaggccaggatcaccgaaggtgcgctgacgataccccacccgtttgggttgagcaccgacacaccgttcaccacggtgccatcgtgcaacactcgcagggcaaggtggctagtgcggatgtccaacacgtcagcggcgtggtcgagcgcccgctgcacctcggcgccggtggcatcgccaccggcgtgcacgatgcgtcgtcgcgagtgccctccttcacacgtcaccgcccatcgcccgggaatcgattcgtcgaaacgcgctccgtaaccgactaattcggtaaccgcgtggtagccttcggctacaatcgaatacacggtgtcgagattgcacatgcctgcccctgccgccagggtgtcggaagcatgggcgtcaacagaatcgtcggaacccggtaacacgactgcgatgccgccttgcgcgtagtgcgtcgctgtctcgccgcgccgctgatcggctttggtaagtacgacgacgttgcgaccggcgcggtgggcggcaagcgcggcagccaagcccgccacgccggttcctattaccaccacgtcagccgcgtgcttccagtcgggaacggccatcattcgccaccgccaggcagcccgatttcgatcatacgctgcacactgcgccggcccgccgccgcgatttccgagtcgacgtgaacctcgtcggtcccctcgaccagacaacgcaacagtgcaccgggggtgatcatcttcatgtacttgcacgacgcgcggtcgttgaccgcgcggaagtcgatttccggtgctgcccggcgcagctgatacaacatgccgacctcagtggcgaccaaaattttgcggtactgcgtctgcctagcggcagttagcatgccgccagtggacaagatcttgactcggtccggcgggaacgcgccttcgccagcgaggtacagcgccgaggtcgagcaaccacattccgggtgtacaaagagctcggcgtcgggatttgcgcgagcctgatcaacgagctcgtcgccgttgatcccggcgtgcacgtggcattcccccatccacacatacacgttcttgcggccggtcacgcgacgaacatgagcgcccagaaattggtctgggcagaacaacacctcgcgactggggtcgatggactcgacgacgtccactgcatttgacgaggtgcaacagatatcggtgagcgccttcacttccgccgtggtgttgacataagacaccacagcagcgccggggtgctcgtctttccaggcacacagctcgtcgggggtgattgaatcggccagtgaacagcccgcccgctggtccgggatgagcacggtcttgttcgggcttaggatcttggctgtctcggccataaagtgcacaccgcagaacacgatagtctcctcgggcacctcggcagcgatccgcgacagcgccagcgagtcccccacgtagtcagcgatgtcctggatggcgggcaactgatagttgtgcgcaagcacagtggcgccacgcaatcgcgtcaaccgacgaatctcagtagcccactgctcgtcaccgtccacgccggcgtagccgaccggtgaatcggtaatgccagcaatcacgacagtcatgtcgccggcgagcggctccatgccattcagcaccgtcacggcagctcctttcggcacaggaggttttcgacttataatcgaaaacatggcctatgctagcaccgcacacgaagtgctagctgtcgtgttccaggttcgccgagttgccgagcaggtgaagggaaccccgcaaaaggcaaaaccgcaacttagcgtgctgttatgggaacgttcccaggatccgcaacgaggcgcatggtcgctgccgggcggacggctgcgcaatgacgaggacatgacctattcggttaggcgccaattggccgaaaaagtcgatcttcgggagctcgcacatttggagcagctcgccgtgttctccgaacctgcccgactaccgggcactcggatgatcgcgtccacctttctgggattagttccctcccccgccacccccgagttgccgccagacacccgctggcacccgctgaacacgctgccatcgatggccttcgatcacggcccgatggttacgcacgcacgcgccagactggtcgccaaaatgtcctacacaaacatcggattcgctctggctccaaaggaattcgcgttatcaacgctgcgtgacatctacggcgcgacgctagggtatcaggtcgacgcaacgaatctgcaacgggtactggcccgtcgcagcgtcatcatccagactggaaccgtagcgcagtcgggccgtagcggcggacgcccggccgcgttgtatcgattcaccgactcacagttaagggttactgacgaatttgccgctgcggccgcccgggaattaaccacgcggtcattactggagcactacctgtactgacggaaacaacgcggcgtttttagggtagtggatatcggcgtgaacacaagtgtgaactcgctaaccacacagcccgatggtatggccgccggccgttcatgcgcacgaataccgactggtcacgaagaaagcctcgtagtggagctcgccaacctggcgaaagcgaggggagttgatcagccgcccgctgcgtgagaagttgcaacataaatatacatctatacatccaccgctgccgtctaaaaattcctttagccgccgcctggctatcaccacaccacaccgggaccgtgctgcgctcccacgacgtcgtcgagatggcgttcctggatctgatcccgtacccccttgcaccacaagccagctgctctgtcgaacgatggacatgaacgtcaagccagaggcgatggtgaccatggtgatcctcccggccggaccagccccgctaccatcgcatcagtgcgtgatcggacactatgtcgtcccgccgtttttcgtcctatgctctgcaacgaaaggccaaggcctgaggttcactgacccaattcgagcttttgatgaccattgctgccctcgccgaggaatgagcaatctcggtacccgaccacaaagggccccacggattgtggggttcgctctaatgagcctggctattacgtgctggacggcatccgggccaccctggactctaaaaatccatcggattttgcccccagttacgccaatcgggctgtagggggatattccggcgacggactagccaaccccgtgggctgctgaagtatgtgccgagtaggcacccaagctggacatcgtcggagcggtgccgggatcatcgatcggcgacccaggccataccttccgtcaactcaacggcgacttccttgcaagtttgccagcactgatggtggtcgccccctatcacacacctatcccgctctggacaaagtcatcaaagagcacgctaacgacgaaggacgcgccctgccaacgcggctgaaacagatgacgacggtgggcgcggtcatcaagatggcgggaagaacattcagtggctatatccacaaaccgctcgcggaaaccctgtccagaccgacggttgcgcatgttttcaacaacatcaaactgagctccggagtgccaaaccgccaaatcttgatcgtgcaggccatccacgactaaacttcatgaccgtgctagccgacgcctatttggccggtagtgccaacatgaccgatcaccagaacccgttagcgagcacatctccctgcatccgctatccgtcctgatacccctgagctggttcgcggaccagctcgccagtcgaccgctgatcaatcagctcatcaggaccagctggctaacgatgctcaatctcgcaacctacgtcagcctagtacgaatagcgataattgccccaaggtcatcatcggcgggaaagtgcatcatcacccgctctgacagctgttacggcacacaggcttcgggctccatggtagcgccttcgcgcttaccgactacatagtctgccgcccaggtcgtcgcgtccgttcgcggcagcaagcaccgcatacaccagcgcagcgatgcccgccggccatagcacggtggccgctacttgcagcaatccgtgcgcgaagaacaccggcggtgcttgaatgacgtgcgccactttgtggtcgtacgacagcggtactgcgtcgaaattcaaggcaccatagcgcatccaaaccaacagcgcccccaccgctgccgcagttgcggcgcagatcatcaagccaatcgcgagcccgataaccatccccggcccacggtgctgacgcaactgccatgccagcaccgacgccgtaaccgccagcacagttaataagcccaacatcaagcatggcgcgacaaagaagtgctcggactcgttgcccaggtagtcgtgccctcgttcgcctgtccgcgtgagccccactaccgcatggatcggtggggcaatccaggcccacagcccgcctatcaacgcgccagtccccgcaaggcccagcaccaccccgacgatcacacgcccccgcggtgggcaggagacatcggaaatgtccgacgcgcaatgttcggtcaccgctttgcctccatgtcgaccgagtccacctgtccgtgccgcgaacacttcgcccgccagccgtcgggacgaacctgcacaaccatccgccgtccgcattccgcgcaaaaccgaggaggctccaggcctaactgggccactgtgggcatcgaagcgccagcaagttcatcccggtgtttgacaccggtatagatgttgtagatgcccgcaccgatcggagtaggaagatcctgaaccacagtccttattttctataggcattttctataggctggcattgagtgccttgataggcatttgtagatcgtcaagcaatctcaaatcggcttcggcgggccgacccaacgtggtcaagtagttccccacgatcactgcgttgatgccgcccagcatgccctgcttggcgcccaggtcacccagggtgatctcgcggccgccgcggaacggcaggatcgtgcgcggcaacgccaatcggaatgcagccaccgattttaatgcttcgctgggcggcatcacctcaagggcaccaaagggagtaccgggcctcgggttgagaaaattcaaaggaacctcatcagggccgagttcggcgagttcaagagcaaattctgcgcgctgctcgactgtctcccccatgccgagaatgccgccacagcatacctccatgccggcgtcccgaaccatcgataacgtttgccagcgctcttcccaggtgtgcgtggtgacaacgttggtgaaaaacgagcgggctgtttcgaggttgtggttatagcggtgcacgccaatgcccgagagctgctccacctgctcgacggtcagcatccccagcgagcaagcaatattaatctcgacttcgttccgaatcgcctcaatgccggccgctacctgggacatcaaccgctcatcgggccctcgtaccgctgccacgatgcagaattcagtggcacctgacttggcagtctgcttggctgcctctaccaggctgcggatatccagccaggcactgcgcaccggcgacatgaacaacccagactgtgagcagaaatggcaatcctctgggcagccaccggttttcagactgatgatgccctcgatctcgacctctggaccgcaccagcgcatccgcacgtcgtgggctaacgccagcaattcctcgagtcggtcgtcgggtagccacagcatctgcagcacctggtcccggctcaagccctcaccgcgctctagcacctgctggcgagcctgagccaagatgtcagtattttcggtatcaccattagttgaccgagtccccgcctgagtcacgcagtactccttttcacgttcaagtcttaaaactagggtccgagcttgcggataccgaagcggttcaccaggctcttcgcggcctgacatgaacggtgtccacgttaggtcagccgtttacgcttgaacaaactcgttgccgtcagccagcgacagcttggccatcgtgccgcggggtcgaaccaccgagtgagtgctttgctggcgaacacccagcgtagctaggtcagctgatcatgtatttgatgcgcttgttaccgtgcccagcggcgcaggccagcaaagtggccgtcaatctgtgacggctggcccgcgatgcgcagagtccgccccagttgagcaccacagacccgacgggccagcgtgacatgcgcgatccactgaccgggcacgctgttgggcagcgggccaccgcagctggcagccggcccaggaagcctaaaagcacaatcgatgcacctcggcgtgcagggctaacagatcgctggttggtaccacgagtcgtgcgaacaccacgtgggctcggccgaacagcaccgacacactgatcgtggcgtccagcagcagccgctgactcaccggaccaagcagctgatcgacctcggcgccgatatgttcagcaacggccaacgtaacgtgaggacggctagctgacgcttggctgggtattccggcgctggccagctggtcccaaatgcgacagatcgccgactcggtgtcggggtcgaagaccagctcgagcgaatgaaccatcaatggaccaacgtggttacccagtcccggtcgaaggccgccgcgctcatcgccgcaaaatccgtggcgtccatcgatccggccccggcaggcaacgtggcccgcattggagccagccgggccagcgcagaccgattggatatctgcaccgcaccgggccgccccgtccagctgccgatcaccaagccggcgcacgcaacccctcgtgtggtcaacgcctccagagtcagcgcggtgtggttgagggtgcccaattccacactgaccgtgaccagtgccagtgcacctagctcgacagctagatcacgcaaagtggcactagcatcagcgagttcgaccagtagaccaccagcgccttcgaccaaaatcaagcgtcccgggcgatccagtccggcgatgagctccagcagttgctcgcgggtgggtaatgccatcccggcgtgttcggcggcggcggccggcgccagtggttgcggatatctcaccaagccggtgagttcggtcaccccagatagtcgggccacctcggcaaggtcatcgtctccgatctgagttccggtctgaaccggtttgcacactgccacttcgataccagcttgacgcgcgtgacacgccagcgctgcacaggcgacggtcttgccgacccccgtgtcagtgccggtaacgaccacgacagtcaacggcgcgccacacaacagccaccaagaacgtccgtcaacacccgccgggccacttccaacttagcgctatcgagagacgcgtgcgcagtcaaccgcagccgcgacgtcccggccggcacagtcggaggccggaagcagcccacccgcacgccggcgtccaggcaggcgatcgcggcggccaacgctacctccggatcgcccaacactactgagaccaccgccgactgcggcagctcggacagatcgcagatcttagccaaggttcgggcgtgctgcaacaccgcctctgggcgccacgtctcggccttcagtatttgcagcgcggcccgcgcggcacctaccgccgcaggcgccaaaccagtgtcgaagatgaacggacgggcggtattgatcaggtgagcacgcaccgcggacgacccgagaaccgcaccaccctggctgccgagcgccttggacatggtagtcgtaatcaccacgtcaggtgcacccgccagcccgacctcgtataccagcccgcgcccaccaccacgcacaccgaggccgtgcgcctcgtctacgaggagcaacgcgccgtgccgacggcatacatcgtgcaactccgaaacaggggccagcacaccatcagcgctgaacaccgactcagtgacaacaaccgcacgctcctcgtggcatgacctcagcgcggtgtccacggcgtcaacgtcacagtgcggtgtcaccaccacccgcgcccgcgacagccggcaagcatccaccagggacgcgtgcgaataggcatcggagacgatcagcgaacccgggccggacaaaccgacaacagccccgaggttggcggcataaccggaagaaaacagtaggccgacacaggcgccgacaaattcagctagctcgcattccaattcgtggtgcagtatggtatcgccggtgaccaggcgggatccggtggcacctgcaccccaaacccgcaacgccgcaacgccgccgtcgatgacgtcgggatgttgggagagaccgagatagtcgttggaggccagatccagctcggtggcaacggctgagcgcggccgcagcgaacggcgcagcccggccccgcggcgctgttgctccactgcttccagccaggccagcggtgacgtctcgatcgggaccttcatgggccttcagcctacgagtcccgcgacttcgaccatcgcggaggtgatctgggcgatctcggccggcgggcaaatatatggcggcattgcataaaccagattccggaacggacgcagccaaacacgtcggtccaacgccgccggggtggcaacggccaggtcgaccgaccggtcgcattcgataacgccgatagcaccgcacacacgcacatcgatcacaccgggtaaaccctgggcagcttcgagcccagctgttaggccagccgatatttcggcaacgcgggacctccagtcctggcccagaagcacctcgacgctggccaccgacacggcacaggccagaggattggccatgaacgtgggtccatgcatcagcgcgccggccgcaccgacgcttatggcgtgtgcgatatcggttgtgcacaaggtggcggccaagctcaggtatccgccggtgagggctttgccgacacacatgatgtccgggctcaccccgcagtggtctgcggcgaaaagctcaccggtacgcccgaagccagtcgcgatctcgtcgaaaatcaacaacacgtcgtgccgccggcatatgtcgcgcacatcacacaaataccgtgggtcgtggaaacgcatcccaccggcgccctgcactaccggctcgacgaccacagccgcaagttcgggggtgtgctgcgccagctgcgtctcaaaggccttactgtaggcagggtcgtagtcgcggggcacctgcggggcaaacacctgccgcgccaaaatgtcagtccacagcgagtgcatgccgccatcggggtcgcagatactcatcggcgtcaaggtgtccccatggtagccaccacgccaggtcatcagccgccgcttagccggctgaccgcggctgcgccagtactgcaacgccatcttcaccgcgacctgcactgaaaccgacccggagtcgctgaagaagaccgtctccaaacccgccggggtgatgtccaccagcaactgcgccaaccgggccgcaggttcgtgagtcaatccgccaaacatgacgtgattcatcgcacccagttgggtagtcagcgccgcgtccaacactgagtggccgtgaccatggatcgcggtccaccaagagctcatcgcgtcgagcgcctcgatcggcttgccgtcgcggatcagcgtcagccatgcgccgtgagcggcgaccgcgaccacaggtggtataacgccggtagcagcaccaatggtgctgtagggatgccacagatgggcggcatcgatcgcgccgatctgctcaggcgtcaacccggaagtcgccccagacataaagatcgagggtaaagcaagaaggcggattagccggggtcatacccgaaccgtctcgagccgtcctgctgtgggtcgcgcaaaccccgacaatcgtggagcattggacgtcatggctacgccgcatcggttccaagacccatttacaaccgacgagatcgacgaccggccgggcgccaacggctggctacaattgcgatgacgccgatacctgcagcgaccagccagcacggacactccggttgcggttggccgtctagagcctaaacttgcccagtcacgctgtggacgctgctagtcgttctgaccaccacggagccatattgattggccagcacagctatactaggtttcgtcacgacggtgtgcccagcaagtatttgcggacggacaggtgtcatacggaatcggtgtgtagatacttccggtggcgtgggggatagcggtgcggcgatcgccgcggccaacatcgagtccttcgtgtccctcttgaagggctggtaataatgtccttctgaccgatcttgtcgttcaccatcctgctagtcagcgttgcggccggttccctaatgaccaccttcagcgaacgttattggctctgacggcgccactgtggtaattcgccacacggtgtgacaacacgtacgagtgtatggttaaccgaatttacagctttgcaagcaaaattaagcgtgccagttaccgtccggtcacgttacgacaaaaaatccttggtgaacgacctaagcttgtgggccaccggcaatttctgctgtaaaagttacagtagtgactgatgtgactcagtggtgattcacgttcccatgcggcatgcggcgctcaaccccagcgggtaagcctcgcgtgagtcatgaaatagcagccgatgcgcgaaagcacggcgctgaggcccaaaacgcccttgaccgccaagaagattggtatccaatgaatcgcatctacaccttcgtgaccggcctagcaatgctagtaacctcgatactcacctgcagtctcgcgtacgctgactccggcaccaggacagcggactaccagcaaactatcgacaccgtcgtccaacgggctctcgcgcagcgcggcgtgccgttctcctgggccggcggcggtgttagtggccccactcgcggcaccggtaccggtagcaacactgtcggcttcgacgcctcgggcctgatccagtacgcctacgccggcgccggactcaagcttccacgctcgtccggcgaaatgtacaaagtcggccagaaggtgctaccgcggcacgcacgccgaggcgacctgatcttttacggtcccgaaggcaccgaaagcgttacgctatatttgggcgacgagaagatggtggaggtcggcgaagtcgtccaagtgtcgccagtacgcagcaacggcatggcaccctacctggttcgggttctcgggacccaaccgacatcagtgccgcaagcacccctgcagcaagtgccaactctgccggcaccgcagcaaacgccaacgcatcgtgcacccttgcagcacatgcccttgcaggtgccagtacgacccgttcag

SEQ ID NO: 123 - DNA (genomic), 36470 bp, MYCOBACTERIUM LEPRAE; double-stranded, circular
  hypothetical: NO
  anti-sense: NO
acaattaagtgagtttaagcaccttagagacactcatcctgccgcgcgccagctcctcaacgcccaacgcgtaaacgagtaggtcaataacgactcccccaggacgccgtaagtctgcgtaatcatcaatccgaacaggacccatatcccgtatccgatcgatgatgtcctgcgcataggcgtcaccgcatttcgttacggcgcgttgagaatgacttccttgtccttgtcgacgaatttccttaccgcaacccagccaacgatcgttctagcacttaaaaagcgcgtgatgtcggcgttggtcaagctcaaacagttggtgaggacatctatccggggcgagcgtgctagcgggatgagtaccgtcgaacgcgaccgacatcccgagggcgaaacactctccgacaccaggctgtgtaaccggggaacaacagattgcaaattacccgctcgtcatcggcaacctctgcgaacgtgcggtatcgctcaaacagaacagtggttccaacaacacggtgtgtgatatcttcgtctgtgtaattggctcgactaggtcgcaagcaagccggagaacacttcaagataccgatactccggacgccttggtcgtcaaagtcaacacggagcaccgtggcaagcgcagccactgctacccctattccgattacctaaaccaagtcgcgaaagctcctcccggtcaacccggcaattatgaacgctgtcccatcacgactgaatacaatcatatgcaatcatgaccgtaatggccgtagatggcgttgtcgaaacgtgggcgttgcgtactcagtgtcaataacccgaagtgtctagcagtggccagcgcgacatcctccagtgccagactgatgtgtacacctaccccagattggtcacggcagcggacagcgaccacgacggccagcacagcgtagatgccacaacacacatcccagaccggtaacacatggctggataggcccagtcatgattggccgggccggtgacgagcgggaatccgacattcgcgttcacggtgtaatccacaccggtggcaccgcagacgcacccaagcaaggtgaaacatcaacgacatcggaacgcttggcagccaagcaatcatggcctaccctggccaagctaacgacgttggtgacgacgatgtcgtccccctcgacgaccagcagctggacgagctgttacccttcggtcgaaagcagatcgatcgtgtccgaacgctttctcttgatcaggacagtaaatcgacgtaccgtctgtcgccatcggccagcgatgtacgtcggaggcatcgctgatcagattcacacggatcaccgcgccaagctggctgaacattgcagcacacaaaggtgcgaagacaaaaattgacaccctaacaacgctgacaccgatcagcggcaacccagggccattcatgttgacgcaaaccattcgaagatcgcgacgctgccgattgcacatagcctccaacccataacattcctgacgacaatcgagttagcgcatcaaggtgattaacaccctgccaccggtaacacccacggggtgacctagtgagatttcctaaccgtgcatattagttcgttcccgttcgacggcaacgaaactccactgtcgcatcaccgcaaatacttgctaggtttcaataaataacaacttggcgcatagccactctcctggtttcagatgtgtagaacgccagtgacttcccataacagttccgggcatatgcaatgacagatcgaaaataaaaacactagagcggcattggccactttgctaggctccccagctcacctcactgtaacctccgccactttagcggcccaaatacattgcggcattgcttcggtcatgaccgagcggatcatcccaggagcgatcgcgttcacccgaacacctagcttaagcaagctctttaaccccagccttggtcatcaccattcccagccttaaccgccgaataattggtctgaccggccatgccagacacctacaagatggtcacaattacgccacgttgttacccccgcatgatcgctgccaccatcctggcaccgtttcaagtcccccgtcagatgcaccaacaatgaccgcgtcgacttgctcttcagtcatcttgcgcaccaccgtaacgcgggtgatcccgacggcgttagccatgatgtccacctccaccgaaactattcgacggccgtccgcacgaggataggacgtcgacgtcggctgcacgaattacttgctacttgcacaacaccgctaaggcaacatctgcaccacccaattgtttcgtcgcaactccaggttgtctcaaggtcctcccaccgagcaccacccgcgccctccacaacgcgccactcgacaatggccagacccagatcttgtgcaccgcctgtgaccaccgtgatccaatcacttagcaacgccacctgtatcccacatccctaaccactattgcttttcagggcgctcgacaaataccaggtaaggtttcggtagagccgaagattcgagccgggccgacatcagcgaggagcgttagccaataaccaccgcagaagtcctcagaatcaatctctggcgaggagttccagcaaatccttgcccaggacgcggttgtgcgcaccgccgacttacatcgaagactacggtctcatcagggacaccacgaccaaagttctggacggattcgaggaatcgtcttcgcttaacacctcgtcagctgctaaaattccccacacatacacatcaggccgactatcttgctcaagaacccgttcttcgccctagtggccgcgcgctcagtccgggaaagcgaccaactgcccctaccgttcggagccaaccgcacctcgcccgtcgcatccagcgacatcgtcaccgcggtgcacaccccacgaatcatctgggcgtggtctatgaattgactggctgacgacgctggacatcgatgagctggcaaagcaacacacacaagccctgggccgacccatcagcaccgtttagccgtccgacaacgagcggctagcgcttcttgataagctataaattagccggccccagcatgtgcgacaacacatcgccaccacggccaaactgcaccgcgaagaccgctatcgccgctcaacctacgatgttgaagacaccaccggccatcccgcacagacagtgcagctctacgtggaacaacaccgcggcctgttcagctgaagagtgcgggcggagggagtcgaaccctcacgctctttcaagcaccggcacctaaagccggcatgtctgccattccatcacgcccgcgagcctgccaatggtaccggtccgctcaccgacgaacccgtagacagccctcccaccttgggttcattatggtcggtgcaaggaacacacagatgcgatcggcacaataattcgaagccgttccgctacccgtcgccaacggcttcaacgactgcgcgatagcccgacggaccaacatactccgaaagactgtttggatctggtgggatcccagaccaattcgaccaacgcgcccgagcgcatcgtcaccatgcggtattgaccatatacttcaacgccctcccaattaacgacgtattgttatctcctcggcacctaatttcagctatgactgcacctcatggagcggccgtgtctagcggctcaggatcgctcttgacgaaaatacccgggatcatcgaccgctgctgccaggcgatcgacctcctgacaccgggacagcgaacgaagatgctacgtcgttccgacgattgcatcgaggtttcactctattaaaactagtgaccctgtttgctgcctcagcatagtcccggcaagaaactatttgagatcgattcggtttggagctctggcaagaactaatcgccacacaagcaacggaagaactcattcgcgacttaaatcgatagcaaccggtaccgtgttatcgccaataatcatggtgtccgacgcaggcaataccacatcatcaaaccaatcctacgatatcagtggactgctctgcgcagcactcgataaccttaagaatacggtggactcggccggacaagtatgccgtcgccatctaccgcaagaccgcagtggcgcgccgcgatcaattcaccgggtccaaatcgtgagcgtaccgtcaaggggtgtccactacacgtcgtcggaggcccgcactagttgctttggtgaccattgcggcctgtggctgcctggccctgggctggtggcagtggaccaggtttcagtcagcctcgggaactttccagaatctgggctacgctttacagtggccgctgttcgccggattctgcctttacacataccacaacttcgtgcgctacgaagagtcacccccacagccacggcacatgaactgcatagccgaaattccacccgaactgctgcccgctcgccccaagcccgagcagcagccacccgatgaccccgccctccggaagtacaacacctacctggccgagctggcaaagcaagacgccgaaaaccataacaggaccaccacatgaccagacccgagacaccccaagcacccgactttgattttgagaagagccgcaccgcgctactcggctaccgaatcatggcgtggacaacggggatctggctcatcgcactgtgctacgagatcgtctcgcacctcgtcttccaccacgaaatccggtggatcgaagtggtgcacggctgggtgtatttcgtctacgtgttgaccgcgttcaacctcgccatcaaggtcagatggccgatcggcaaaacggtcggtgtgctgctggccggcaccgtcccgctgctgggcatcatcgtcgagcacttccaaaccaaagacgtcaagacgcgcttcgggcttagacacagtcgaacgtgaagcgcctggccgcacactcgttctcgcatcgcggccagcttcacgttcgcatggcaagaacacgcagcgcaggcatcagcaacgttaacgcacggaagcgatgcgagaacgcatccttttccgccggccttaattgagccactgtgcggcctcccaggccaggaccgtcaggaatgaagatcgaatcatagccaaacccaccgtaaccgcgcggctccctggcaatcgtgcccggccacacccctcggacgacgacttcgtcggactccgagaccagcgcacaggccgacacgaatgccgcgctgcgccgctcgtcaggcacatcacacaattgagccagcaatagcgcggtgttgccggcgtcgtcgccgtaactacccgaccaacgcgctgacagcacccctggcatgccacccagcgcagccgcctccaaacccgagtcgtcggccacactcgccaaacccgtggctgcaaacgcatcgcgtgccttggccaacgcgttgtcctcgaaagtggcgccggcttccggggcctcatcgaacggcaccacgtcgttcagcgataccagcgtcaaccccgacaacccggcattgtcgagcacacggcgcaattctgccagcttcttccagttacggctagcgaccaatagcttggtcacaagcgccacccctctcgccgcttcacggctgggagatacccccacatcatcactccgctctgcatcgtcgccggcacactcagctgccgaacgccttcggcggtggcggtccctcaggggacataccctgatacggcagcgccaacgcatcgcgctgtgcaacgaataacttgtcgcaagcacccagtgccatatcaagaagcttgtccagcgtcgaacgcgggaacgtggcgccctcaccagtcccctgaatctccaccagcgtcccggtgtcggtcgcgatgacgttcatgtcgacctcggcccgcgagtcttcctcgtaggacaggtctacccgaatcctgccgtcgaccacgccaacgctgaccgcagcgatggcacacgataacggcctgggatctaataacctgcctgcagccgacaggtaagtcaccgcgtcggccaacgccacgtaggcgccggtgacagccgcagtgcgagtaccaccgtcggcttgcaacacgtcgcagtcgacggcgatggtgttctccccgagcgccgccagatcgatgcacgcccgcaatgaccgcccgatcagccggctgatctcctgtgtgcgcccgctgagccgacctttcaccgattcgcgttccgaacgagtatgggtggccgacggcagcatcgcgtactcggcggtgagccaccccttacccgatcccttccgccagcgcggcactccctcggtgggactagcggtgcacatgacttttgtgtgaccgaattcgataagcaccgaacccgccggatgttcggtgaacccgcgagtgatgaccaccgcgcgaagttcgtcatcaagacgaccgtctgctcgtgtggacacgcagcaaccctagcccgccgagggtggcgcgccttcacggcgtccgcgcaagaagcaggcaagcaacctgcgacaagccgtaagccagctcagactcgttcgggagcttggatatcgaaggtctcaccggacaccaccgcgtgcaccggaccatcgaattccgctttggcctcactaataacgtcctcacgtgacgtccaaggcgggatatgcgttagcaacagctcacggacacttgcttgtgccgccgccctgccagcctcggtgcccgacagatgcagattcggcggtctgtccggcgagtgtgtccaggatgcttcgcagaggaagacatccgcaccccgagccagttcgacaagttggtcgcagctaccagtgtcaccgctgtagaccaacgacgcaccgctgggatcggtgatacgcaagccgtaggattccgttggatgagccaccagccgcggcattatcatcagcgctcccaggggcaccggttcaccgtcgacccaatggcgaacatcgaagatatcagagcaatcgtcgatctcgccgccgtacggtgacgacgccgcccccaaccgcaaccaggtatcgtccgggccatatagcagcgccttgcccaccgggcgtgtcggatgatagcgacgccacacgaacagtccgggcatgtccaagcagtggtcagcgtgcagatgtgacaacagcacatgcaccgagccaggatccgcgtgtcgctgcagcgcaccgagcactcccccaccgaagtcaagaaccagcggcggggtgtccggggctcgtagcagataacccgacgcaggcgaatccggccccacgacactgccggagcagccgagcacggttatgcgcacggtcactactgtgccatgcccgataccaggatgaggaaaacattgcccattaaggtgatcagaatctcttgcactcatctaacggacacgagaatgaagtcgcgcaggttgaacaccactcaccgctggaccgagaaatcgcgcagccaactgaatgaacgcttcggggtcaccggtagcttcgaaaacccggttaacgggcggcgcgtcatgtcgacgcaacaggtctctttcggtaagcacccgcagcacttccttggcggtctcctcggcgctggagaccagcgtgacgttttctcccatcgccagttgaatcagtccagccagcagtgggtagtgtgtgcaacccaacaccagcgtgtcaaccccggaacgctgcagcggctccagatacccttcagccagtccgagcacctgacgaccgctggtcacaccgcactcgacgaagtcgacaaagcgtgggcacgccaccgcggtgatctcggtgtcgcgggcagcagcaaacgcatcttggtacgcgtgcgaggctatggtggcccgggtgccgatgaccccaatgcggccgttgcgggtggcggcaaccgcgcggcgcactgccggcaaaatgacctcgactacgggcacatcgtagcgctcacgagcgtctcgcaggcacgctgcagacgccgtgttgcatgcaatcaccagtatctttacgccgcggcctactaggtcgtcacagatagccaacgcgtgcgcacgaatctcagggatagagagcggtccgtacgggccgttgccggtgtcacccacatacacaatatcctcgtcaggcagctggtcgatgatcgcccgcgcgactgtcaagccgccgacgccggagtcaaagaccccaacgggcaacagcggcgagctcatgtcttcagacgcggcgaatcggtgccggcttctttgagcgcgcgggtcttacgttccggcgcggacaacagatatgcggccacgacacctgagatcgcgccacacaaatgaccctgccacgacacaccaccgcatctgccgagcaccggcatgacgcccaacagcacaccgccgtatgcgaataagaccatgcacccgatgatgtcccaccccctgcggacgaacagcccgaacaccagcaagaaagccagccagccgaagatcagaccggagacaccgatgtggtcggtcgggccgaagctgctgcccatattgccgataagccaggtggcagagccgccaaagatccataccatcgcggtgacccaaatgaaccgggacaatccggctagtgctatcagaaaccccagtaccaggagcgggatcgtattggccacgagatgttgccagttggcatgcagcacaggcgcgaagctgatcccccacaggacgtcagttttcaacagcctaatcccattgttatccagggaatgccgcgtcagttgatcaatcaactcgacgaggtaaagcaacgccataaaggtgaggatcgtgaccccacccaccatccaccgcagacgcctgtttgtctcggtctccggtttatagcccaggtttttctccggcagggtcatgagcgccgatcctcccccgcaagcggatggtgcccccacctcatcacctcctttataccagtcgccggttggggtcattgagcgtcactccattatcatcgcttcgctctgcatcgtcggccggcacgggtcatgcccataactgcccgtccagggcgtcctcagcctcatcgccaggctaccggggtagggccgcccggtggaccgatatttccagccgacatcggcaaccaccaacgcgacgtcagcgcgttcaccagccgctagcaccacggattccatcgcgaaagcgacatgcagcaccgcaccggttgagttgagaggccagcaaagatgccttcggaatccactagtttcgggtacgacacacagcgtcggaggcgcccaccgagtatcggatggtcagcacgtccgggtcgtatagctcgggaacaaatccttcatcaatgttccgcagcgcatataccccctcgttgtctcgttgtagcggggttcggcggccacgatcttgacgccagaaacatgctcacgcagaaatccactagtaaccatcactgtacccgtggcgcctaggccggcgacgtaatgggttatttcgggcaggtcagcaagcaactcgggtagttgctacggtagtggtagtcgatgttggccgaattgccgtactgacacagcctccccacaatggattagcaacggccagcctctttggcggcggctaccgcaatgttggatccgccctttgttggcgagaaaactatctgctcaccatagaactctaacagccgatggcgctcgaccgacgtgttttcgggcctcacacccatcagcttataactcttgagccgagctgccatcgccagttatataccaatgctaccatgattaagtaggcttgagtctagtcgcacccggcgccagcagcctgtcgtcttcggcctgctagatcatccgcaacgccagccactccttagttttagtttagtcaacccagtaaggttgcggcttaagcttcgcccacagcagcacatgcggctcgtgcgccccacaggactcgtgacgacagccgtagcaaaccaaccactggtgtattgcccagggcctgcaacaacgagtcatatacgcttcgtatactccagctcacccacctgccacagcaagcaagatggtgaccgaatcacccgtagactaacgcagtgcgtaagttgccggaaaaccgcacgtcctcgtcgttgacatagatgttcacgaagcagctgtaacttcccgttatcaaccaggagcttggcgatactcgagtagttgtactctaggccactaaataatgaccaccctagtgtgtcgccgctggcagatacgcgcttctggacaccgatgtggggtcgcaggctaatcggggttagagtgtaaaactccagtgacgctcatgtgagcctttctcggaatcgtggagaaccttttcggggggtattcagtactgttcgtacgttataatgatggatccctcgatgacgacggcggtactagaacctaggcagctcgtgactgtctgggtcgcgggtagacaattaaaaactacacaatttacgtcccggccagcggctaggttgacattcgtacggctggcatacccgctagatctcgatatgtgagtgtatagatgacgacggcagccttacctgtgtcctctatcgaccgccacacgtggagctgcttttgcgcatcgaatcagtagaacgtcgacgaccgctcagcgttgaccattgagatgtggcgcttgggggcgatcgaaaccctcgagaccgaccagcaccccacacgcttcgtcagggtggtcgcgacgtgcgtgggacactatcgcctccaccagtcagcacgaatcaccaccacgtcaacggttgccccctccgattgtggtcccgaacgctccaggaaacatgccgcagtaagtcggtattccagcgaccgactcggcagccagcaccgcaaccagcactgcacgagccaaacagtcgtccgcagccgcaccgacctcagtgatcaggcccgtctccggcgacatcgcgacgggtacatcagccgtcgctgtggcttcgaccgctccggtggccagtgcgaacaccgtgtcaccgtccagcgcagtgtgcgctggacggatagttcgggccaggccgtcctgagcggccattgcgacacgctggcacgccgccgggctcagcgtggcatcggtcgctaccacgccgatcgtcgtgttcagcgcgctcaacggggactttagctgtgcaaacccggcgatctgctcgggcgagggtggtcgcagagcgaactcgtcgatcagatctgtcatccagggcagaccagtggcgcggtcgacgacatcgcccacggagttcaccacgaccaccgcgcccaccgtcggccccgactccagtgtgatcgacgcggtgccgacaccacccttaagcacgccagcgcgggcccccaccccggcacccaccgtcccgacagccacggtggcatcttgaccaccaacagcggcatcgtaagcggcttgacaagccaaatagccgaattccgctgtcggtcggcaatgaaagtcaccgactgacaaatcgaaaatcaccgcacccggcacgatgggcaccactccgccgagcatcaccacgccgcgctcgtgttcctccagccagcgcatgacgccatcggcggctgccagaccgtaggcgctaccgccggcgagcaacaccgcatcaacgaaccgcacactgttggctggatcaagcaaatcggtctcccgggtgcctggcaccccaccccggcaatcgaccgcgccaaccgtcccaggcggtgtcagcacaacagtcacaccacacgcccaacccgcaccaagggacgcatcaggatcaagcctgtggtagtggccaacctggatacccgaaatgtcggttatggagttcatcggcgctgccatcaagatcatcaggtagccatcagcgccaaaaccaagtattcctgcaacaccgtcagccactggtagacgtcgaagtgcacggatagtggatgaccggccggcacccgttcgggtgccggccggtcgatctcgagtatgacacccagtgccagtcgaagatcgttaaccgcagcgatccaggcattcgcacttgcttcagtcaattccagccggccgtcactttccggaagcgtatccaacaactgctgtgcagcagagcgtttggcgtccacaatctccggttcgtgcagactgcgcaacgcggcgttcaggctatcgacggcatcgagagccgcggggtctaattggtccttgtcgtccggagtgtagaaatctggcaacagccgacgcaacgtcgggtcctccgggcgctgcgcattcccggctttaataccggttattacctcaagttcgtctagaggcgaggaagattcacgctcgttcagcaagccgagcagcgcgccgacgaggtgcttgagcagggcaacctcgtgcggcgccacgacggaccgaaaacgggggccgttggcagtctcaacgcgcttccatttgcgcacgaacgatcctggataccttcggacctcaccggtcctgctgcatcgtcgcccacaaaccggcggcatgcagcttggacacatcgacctccatggactcccgactacccatcgacaccactgccttaccttcattgtgaacctgcagcatcagcttggtggcatgaggctcgctgtagccaaacaatttctgaaacacatacgtcacgtacgccatcaagttgacggggtcatcccacacaatcgtgacccatcgagcggccgtgatgtctactggagctgactcgtgttgccaggttgtgttcggcctcaccttcggttctatcggagctaacgtaacaaccatgacccacacgataccgagcttgcgctgacagccgttaccgttgcggaatgaacaactcggtcttcgacgagctgctgaccgacaggtacaaattaactatgttgacaagtgacattacacaacggcaccactcaccgctgaaccacattggaagtgttcacctgccgactcccggatagtcgccgttacagggtgattgccgtaatcggtcgattgctaaaaaccttgccccagttgaggttcaacgatccctgccagttgctggcccaattcctcggccccgacacgttgaactatctacacggtttccggttcggcggcgacatcgacgggtacgcaaaaggtgaactctaactttcccgggtcacctgtacctatcggtgctcggaacctgcgccgaatgcgtggtgatcgaaacgctgatgctatcgatcttcaaccacaacagtgcgatcgcatctgcggctacttaccatggtcagtaccgctggggaacgcccgctgatcgaaatgggatcgcgacatacccacaaatacgccgcggtcgcggcagctacgcgctgagccccggccgcgtcgaccgcaaagggctggaaacgcggagcttgctgcggacaaaatggtactgcaggctacagccggcaacgcaagcttacgcgatttgtgcttgcacatagctgaccgcgccgtgttggtggttgccgacccagcaccaccgttaactccgctaccgacacgtgcgggatggcacctacctgggtattggcagacccgcacacctaacgtgaacaccgccgcaggtgggaggaagtgatcacgcggcagtcgatgcatgtggttcgccctgaaaacgccaccgccaaccttcgcccgcttgccgcgcgcatcgcgagtcgcttgatcgggctggttctcgaccgtggcgtggcacgcggatccacccacttgggggtgttggaggagctagaggcgactgggctgccggttgaccagttcggccaacatcaccattagcgcgatgatcgtagcccttgccgccacaggcatagttacgactgcgatagacacccatgtctacgagtacttgctgcccaaaacgtacaccgtaccgtacgaaaacagcctgccggtagccgcgttggcgggcgacgatatcccggtgatcgccggccgtaccagcgccgacgatctcgcctccagcacgccgcaagtgccgaacatcgtcgacacctgatgcacacgacgacaattcgcagcgggatggcatcggcagcgacgctaacccgcgccggcatcacatggtgacgcatagcaatgtagtcggattcctgcaattccaccagagacagcacccgccagaccggccggatcgcagtccgcgaagtcctagcgtggcacaccgataagtgccgcaaggatccacttattcaacttcaacgcaaatgggctgccgccgcggtgaccggccgcgacgagaatgccatgcgccatttcgaagcttccgctggcgcgcaacggccgagatcgactcgatctagtgacccggcaagtctactaagagtaagagtacgaacgcacttctgaacagggaggatcggcagaaggcgatgggtcttatcaaccaggagcctgcgctggcgctacgcattggcatacggcgtcgaagtggagccactcatgcaactgcgccaggagcatcaagccccccaagaactgaagcctatgcacagctggacgagattggacagcgttgcgcaatccatcgagctaaaccgtcccaacctgcacacagtagcggcgcccgacagaacggtcacaatcatgttcttcaaacatcgaaggctccgacggtgttcaccaagtaactcgggaacgagcggtggctcaagctgctgcacggccacaacactgtcatccgtagtcatctaacaacgcactgcagctttgaggtcaaatccgcaggaagatggattcatcgtaacgttagacagcgccagcagcacgatccgttatgcaatcacgctccggcacgacttcgcggagcgtcatgatcgtcccaatagccggggtgttgcatgtccggatcagactgcacgctggcgaactgatccgcgagcaaaagaatttctctggtcacaatgtgatctcttcgcggcacggattgcggcaaaagcaaagggcaacgagctcctcgtttcgtcgatgccaagcaaattgatcgccggcaatcaaaagcttcagttcggtgacacaagcgaggaacagcctcacggggctgccaaggatccgcagggagtcatgaggtaggtgggggccgtatctactagaagtaggatggccagacccagctcgttactggccgcaaacatcggatggcgaggcaagattcgcaccgtgtatccgaaacgcccaccccgcgcaaaggcagcagcgttgtcgtagaaaagatctcgttgccgccctcggcggtatagatgtaggtcatttcgatattgacctgatctatcaccatatcactgcctcccaccctaccaagcaccgcttgcaccgtcacctcatcgggccccaagccggccagctgcacggtggcagtcagagtcaacttcgatccaagcaccgggttatcgggcaagacggtgccgtcgacgtaggtgatgtcaatcatcggccatacttcttctacgcgctgacagtaaacaaccagcttgcgggccatacctcacccaccgtctcgccgctctcgggcggtgcaaccgtcctgcgcagctactgcgccgcagtcacgtagcagtgttcgacgtagtcacacatctatacgggatgcccacactttcggcccaaaacgtctgcagagtgtgtcgcaccatttcgatcccccgtgacagaaccccgcgttcgtcacgttcatagaacttcggtaccaccgcgtgttctaggaggtcgtagagcacgccaacttccagatcgcctcgacgagcctcgtccgccacgctgttggcagacggtatctctccgtcgcaccattcgtccaaccagccatcgcgtatggacagattcaatccgtcgttcagagcactcttcatccccgaggtgccgcacacctacaatggtcgcagcggattgttcaatcaaaatcacagccccagttacaatttgcggtctatcgacatgttgtaatcgggcaggaaggcgatacggtggcacacctgcggacggtcagtaaaccgcgccacctgttggattcaatgccttgccaccgtcaccagcggggtgcgacttctcggcaacgatcacttgttgtcttcgagcagcagccgttccagccgatccggatcgcgcaacatcaaggtaaggcacttatacttgggaacgcggcggcacgaagacaatagtcagcacagtcggatcaaacaccgccctgctccagcccaattcgacgtccaacgcaccgcgttcccaccgggagcaactcaagccgctcccggatgtcatcaatcagttgcgagcggatccaccacaaatggcccgaatcaacctgttgcaatcgcagccagactccgaggtcactgactgaacgaatccgacccagctagttcgcatcccagctgcaaccactgtggcgccacccaagtgcgcacatgcacgccattggtaatcgccccgatcggcaacctcgtcgtggtcaaatccgcaccataactggctgaacatgacccagttcaccaggccatgcagcagcaagatgccgttggcccgttgcgccagccgcagacccatgtgtgccatgttgaatttggtcagattgccctcggcgccaagtgcgaggcttcgctccacaggaaccccggcaacagtgcgagcacatccgagaagtagcagcaccccagactctaccgggaaccggtcaatatcggcatgcaccggggtgtccgtgatgaataccgtgctggactgcacgacagccagcacggtgtcgaaatcccatcccgaatcggtggaccaattcgcggatgtgttcggttacgagggatccggcgtggccctcgttcccgtggaatcctcgggcgcgggcagccccgcactgaaggtacacacgcggatcacccgcacaccgccgataccgaccaggacctcttgttgcttgatgcgatgctcatgatcacctccatagagtcgtccagtaacgtcccgcagatcgtgctcgttctcagggacgtcggagtccagcaaacacaacggaacacaacccaccggcgcgaccccagatccgggtccgcagctacgcagcgtcgggcaaagtcagctccaaccaacacaggatcgccgttgccagcggtgagtagccaaaacgggagcccttgcggatccagcgacgggtaggtctcgtgttgccagccgttctcggtccacgactgtcggaagtgccaggagcagtaggagagaaccaccgcaatcagctgcacccccagatcggaggcggccttcaggtgaccgccagccagaatgccgaagctgcccgagtaatttgggtaacgcctcggcgactccgatctccatcgaggagtacgtatatggcgttgggcatcatcacatcagcctgctgctattgataccaccgcgaacagcttagttatagtcgttcaagtcggcagcccgctcatcgagtcggcacaggaacccctcgtcgagtgccatctcgtcgagccgtgacggactcaccacttcacaatagcgccaccgggtcattgcccacacaacgtcgaaacgatggtcgcggaatatatcttgcgtcgacttgtcctacgaccaccgcaggttggtcaatagctagtcgagcgcggcgaggcagtccgataggtgggcacgaacggtaaaaatggtaaaataataaagagctttcacactccaccaccaccttacttaggatttattacttagggattccggtgcacgcatggctacttagcaaccgttcatccgcaggagcgtgactagcaactaggatgaatatcgggtagctaatgggggcattccgccacgaagtacactgggtcaccctcgtgtgtggcaagccgcgaagcagaaggagtggtggtggcccggtcaggtcaagatccataacgtcgcaccgatcatctcctgcggcatgtaccctgctaaagccgtagtcggcgaaatggtcccggtcagcgccacggtatggagagaaggccacgaagccgtcccgccccacactggttgtccgcaacctcgggttcgctgtctgctcgcgacgaaaactcaccgaatcaaggtggtccaggacctcaaagcacgtcctgcagccacacccaggtccgacgagtcgagttgctgctgattcacatgacgatgtgtcaagaaccctacgtttttcacggtcagttcaccccccgaccgcgtcggattgtgaaacttccgagtcaacgcagctggggcgatccgatgcacacctggcggcatgcgctgattgtcaagttgcatgccgaccagggtgaagacagaattgtccaacgatcttttggccggagcagcgctgttcgagcatgccgcaaccggtgtatcgcgcgctgcgtggcctgctgctgacggcctcgacgaggttacgcccccagagatccggtgacccgcaccacgctggcactggcgcccgaaatcgatgaacttttgacgaattatccgctgcaagatctggttacccggggcgagcagttcagagtctgggtggatcgaccgttggcccgttttggctcctggtacgaaatgtttccgcgcccgaccggctgctgggacgccgacggtaacccggtacacggcaccttcgccaccccagccgcggtacttcgcgtatagccgacatgggattcaacgtggtgtacctgctgccgatccatccgctcgacaagatacatcgcaagggtcgcaacaattactccaccgccgcaccgacagatgtcggatctccatgggcgatgggtagcgatgaggatggccatgtgatgtgattcatccaagcctggaaactatcgacgactttgtttccgcggcaagtaaactaggaatggaaatggcccctggatctggcgctacaatgttcgtcagatcatccatagatacgccaacatcgttattgtttcaccgaattaccttatagcacaatagcttatgcggaaaatcatccgaagaaataccaggacatctactcccttaaacctcgagaacgatcttgtcggcctctatgacgaagtggttcgtgtagtgttatagtggatcaatcacggcgtcaagctgtttcgagtcaacaatccgcataccaagtcacgcgacttctgatcctggctgatctgtaaggtcacaatcaccaaccccgacgtgctcttcttatccgaagcttttacgtctccggcacgccaatacaggctggccaagctcggcttcacgcagtcttatacctacttcacctggagtacggccaagtgggaaatcatcgaattcggcaacgaaatcaccgactacctcaggccgaacctgttcgtcaacacccgcgacatcctgcatgcagtgctccaccataatggcccagtcatgttcacgatccgcgtagtgctggcggtgaccatgagtccgacttgaggtgtgtactccggttacgagttgttcgagcagcgcccggtgcgggagggtaacgaagaatagctggattcagagaaataagaattgcgctctctcaactatgctagcgagcttgtcgaaggaaaatcgctggagaatttcattaagtagataaaaaattcgcaaaatccatcccacactacagcaattgctcaccattcatttccatcatgtggacaacgaagcattgctggcatacggcaaattctatacggctaccggagactgcgtgttggtgggtggtgacactcaaagcacttggtcccgagtaagctacgctgtggttagacatggctaggttagatatggctaagttgagtatggatccctacgaaaggttttgggtgctcgatgagataaatggccagcaataccagtggaagaagatgaattatattcttatcgatctccaagtcaagcagtcgctcacatcattaatatgccactcctaaagtacgaataaggaatcacgctgctaagcaagaggtgaaaagatccgagggaacaaatgcatgagccgaaccgaccaactctccgggagccacttggcaaccgagccagccgacgtgacacgcctgctgtccggcgcacaccacaatccgcacagcaccttgggcgctcactaatacggtgaccacactgtcatccgagcgtttcgaccgcacgcagttgacgtcgtagcggtggtgggtcacaaccggttcccgttgcaaaacctcgaatacggcttgttctctgtggcgataccgttcgtcgacctcatcgactatcgcctgcgggtgagctatacgggtcccgaacagacaccgaatgtgcacactgtcgccgatgcttaccgctttttccccctgagcgaagttggtcttcatctgtttgccgagggccgacacgagctgctctgggaagttcttggtgtccatcgacgctcgttcaccacggccgacagcgcggtggacggggtgtcgttctccatgtggacacctaacgctaaaggcatcagcttgatcggcgaattcaacagctggaatgacaacggtgccccgatgcgagcgctgggcccgtcggaagtatgggaattattctggaccggcttccccgccgatggtctgtacagattccgggtgaactgcgccgacagtgtcatcactggatagggccgacccgttcgccttcggtaccgaagcaccgccgcagacggcatcacagatcacgtagaataacttcacttggagtgaagacgaatggatggcacaccgtactcagcgcaacccggtgtttgatcctataggcacctacgaagtccatctcggctcgtggcgtcccggactcagttaccgtcagatcgcccgcaagcttccagactatgttgtggcgcaaagatttacccacgttgagatgcctccggttgcggaaaatccgttcactggaacgtgaaaataccaagtcacgtcgtactacgcgccgacatcacaatttggcactcccgacgcgttccgtacgcttatcgacgagctgcatcaatccggcatcggtgtcagcgtggattaggtgccggaaaactttccaaaggacgcataggatctggggcggtttgataggacacccttctatgaacaggacgatcctatgcgcgatgagcaactagactgggacacttacatattttatatgcgcaacttcttgatggccaatgcactgtactggctcaaagagcttcacatcgaaggattgcgggtggatgcggtcgcgtcaatgttgtacccggactactcacgtcccgagggcaactggaccccgaatatccacagcgggcaggagaatttggaagcggtacagtttctgcaggagatgagcaccacagcacacaaatccgcgccaggcattgtcaccatcgccgatggagtcgactccgtgactcggcgtgaagcgacttatcaacattgtcgtactgggcttttcgatgaagtagaacatggggttggatacacgacacactcgactacatcagccgctacccagtgcatcgcagctaccaacacaacgaaataacgttctccatgctgtacgcattcagcgagaattacttgctgccgctcagccacgacgagatggtacacagcaagggtgcgctgcggagacggacgtcgggcaacaaccacaccaaggcctccggactacacaacctactcgcctaccagtgggcacacccaggcaagcaactgttgttcatgggccaagaattcggccagcacgccgaatagtccggagcagcgcggtctagattggttcccattcgacaaaaacggtttctccaaagggagtcttgctcctcgtggacgacctcaacgacctctacctcagccacccggggctgtgtgtggattcaagacaccctcaccaagggttattcctggatcgacgccaacgagtccgtcaacaacttactgagtttcctgcgatatgcccacgacagctcggtactggcctgtgtgtccaatttccctggctcaaaacacaaaggctaccgactcgtcctgccgtcggccggacgctggcgcgaagtgttgaacaccgatactatcgcctacaacggctccgaggtcggcaatattggtggcgtcaacgccaccaatgacccgtggcaaggctgcccggaatcggcggtgttggtgctgccgctgatgtcggcatcgtagttagaattcaataacgcaaaaccctagtagcgcaagagccaagaaggactcagtacaatgcgttggcaaggttgcgtcgaccgacgatgacattgggatcgtcgggatcgaagagttcaaacagctcgatcagccgagtacgtaccgaactgcgctcatctccagatgtgctgcgcaccaaaacaatcaggcgctcgaacgccgcggtcacatcttggttgaggatttgcacgtcagcagccgcgaacgccgccgcaatgtcacccggcgcagcatcggctaccgcaaccgcgtcgggatgttgctgcagttgcgcgcgtaaggaagtcgatctgccggatcgcggccttagcttcgacactggccggatcggcatccaaaatcgcgtgatatgactgcttcgcagtgaggaagtcaccggcttccaattgctggcgagcttgggcaatcgcaggatcaatttctgcagaatcctcagaacgagttgggcctctcagtttaccggctgtcaccgatagcaacgaatccagccagcggcgtaactgatcgacggactgcatgccctgaaagctggacaacggctgcccagcagccagcgcgaccacggtcggaaccgcatcaacaccaaagatctgcgccaccctgggcaccgcgtcgacgttgaccgtcgccaacaaccaggtgccgctgtcggcgaccgccaagccggatagtgtttcaagcagctttacacacgcatcactgcgcggtgaccataccagcaccaggatcggtacttcgtgggaccggaccagtacttcatcttcgaaattggcctcggtgatctcaatgaccgaggtgttttcggagctaccggtgccacgcgctcccaatgttgctcgactggcggggtcacttgttgaagctttctgccgagctcgctgcttcagaccggaaaggtcgaccgcaccggccatggcaggcctgatgggggatcgcggagacgtcacgttgtcaagtctgtcacgtcgcatcgggtaccgatacactcactggcgcccatgcttacgtagtcgcaaaaccggttcgaaaattgaattcgggcgccgcaaaccatttttgtgacgtaaatcatattaccccggacgcgtcgcaggtcagaactaaacggcccgcagaatcagcgcatcaccctggccaccggcaccgcacagagccgcaacaccataacccgaaccgcgacgcgccaattctagcgcgacatgcaacgttattctggctcccgacatcccgagggggtgaccgacagcgatcgctccgccgttgacgttgacaagctcgggggcgataccaagttcacgggctgaggccagcgccaccgccgcgaacgcctcgttaatctctacgacatcgagctgctcgacggagataccttcacggtcaaccgccttcttgattgcgttggccggctgggattgcaacgtagaatctgggccggctacaacgccgtgggcaccgatctcgaccagccaagtcaaccccagctgctgcgccttttccttgttcatcaccacgacagtggctgcaccatcggagatctgcgacgcagagcctggagtaatagtgccgccgcagcgaaacgccggcttcagaccggccaaagactcggcactggtgttggcgcgaatcccctcatcctcagtgaactgcagcgaatcacctttgctctgcggaatactcaccggcaccacttcgtcggcgaagacgccgtccttccatgccgctgccgccttttggtgcgaccgggcagcaaactcgtcctgttcttggcgcgtgaatttttcgacatcattgcgctgttcggtaagcgcgcccatcggctgattggtgaacacatcgtgcaggccgtcataggctaaatggtccacaatggtaacgtcaccgtacttgtaacccgaccggctatccatcagcagatgtggtgccttcgtcatggactcttggccgccagccaccaccacatcgaattctccggcgcgaatgagctggtcagcgagtgcgatggcgtcaagaccagacagacacatcttgttaatcgtcagcgccggcacatcccaaccgatgccggccgctactgccgcctgccgcgccggcatctgaccggcccccgcggtcaacacctggcctataatcacgtactgcacaatggaaggtgctacattggctttcttcagcgcagcggcaatggtgatcgcgcccaaatcgctagccgaaaagtccttcaaagaccccatcaacttaccaatgggtgtccgtgctccagtaacgatcaccgatgtcgtcatgactaccccctagccctgctctcgggtcctctttgcaggccgattcgaacctgctggagaaacgtgctctttcccgtcaggctaccgttgtgtgatgacgaccgatcaaatcaacacttgtcagctgctggccaccactctggtgataacgatcgatcacgtcggcatcgcggtagccgacctgaatgcggccatctcctggtatcatgaccacctgggcatgatcctagtccacgaggaagttaacgacgaccaggggatccgtgaggccatgctatcggcacacggcgcaccaatcggcacaacccagattcaattgatggccccgatcaacgagtcatcgccgatcgcgaaattcttggataaacacggaccaggcatccagcagctggcttgccgggtcagcgatctcgaccgccttaccaaacgactccgcgcacagggagtccggctggtctacgatacacccaggcagggtacgtcgaacgcgcgaatcaacttcatccacccgaaagatgctggcggcgttctgatcgagttggtcgagccggcttcctgatgcttagacactcaaaactatattccggatcggaccacgggtagcgcggtgagcccaacactgggtgtaccaatgtcgccgatcgtcgatgccggcttgccgtgaatcagccggccatgccactaaatgcgcagtatcaacatggatttcgtgatcacatccagaataacgataggttttccggctcgggctgcaacgatcggacgcatttcgcactcacaaccgtcaagccctgtttccacccggaatagaaacggtaatagcgatattggctgctgcccatgcggcgatgtgcggtgcctagccatggcgtcagtctaatcgggagattttagaacaaccggtactcatcgctgtccatgccccgcatcttgtcgtaatccaatgttacacaacggatgccacggtcggtggcaaagtgcgcgcctgcggcttgatgtgttgagcggcgaacaccccccttaccggcgcgagaacactgttccgattaagtaacgctagatagcgggtgagctgctcaacgccgtcgatttcgccacgccgtttgatttccaccgcgaccgaaccaccctgctcatcgcggcataacaggtcgacagggccgatcgcggtcatgtactcacagcggaccaacgtatatccctcgcccagcagttggacttgctcagcgagcaaagtttgtaggtgggcttcgacgccgtctttgaccagcccggggtccacgcccaaatcgtgacaggaatcgtgctctacctcttcaacggtgatccgcagttgttcgccagccttgttctcgaccacccaggccggcgaggcgccagcgacgtcttcggtcaaccaacatggcggactcatccagttcaacggtttgtaggcgcggtcgtcggcgtgcacactgaccgatccgtctgccttaaacagcaacaacctgcgcgcggacggcaggtgagcggtgagccggccaaggtagtctacggtgcactgggcaatcactagacgcacccaactcaccttagagtgtggccgacaaattaggctgtcaccaccaagtttacccctagacccccactagaaccccacgaaaaaacatgggccgcaacggttgggtcgggtgctcacgcacggtaactcatcagagtggccagttggaagaaatccctgcttatgactcctggaggtttgtccgggtgtcggaaaacccgggacgtcgacggatacgcttccagatcatcttggctgtccagatggtaaccgtgaacctgatcgggatcggtattaccgtgttcttggtaacggttatcataccggcatcacatgtgttgacgtacgccccgatgtgggtcacgttcgtgataagataagtgtgctgtggctaccttggcattgggcgcatacattatcgttgccgaggaggcaccgtgctggcccccactgggtgatcaatggagcgcaaacccatccgcaacgacgcgtggaacacgttccggataccatggcgagtcgggatagtcgacttcctcctgtggctgggtaggctcagctctgttcacgatactctatggctctggtgaacaccatgttgttcatcctgagcttcctgttcgcagtaagcttttgctgcgtattggtcagcacaggcaattacctattcaccaagtgaacgctgcacccagtgggggctcaggcactcaagaccggactgccgccacagcgattaaggatgggaatcatgtccggcccatgacagtgtggctaatcgattcgtgccagtcatcggcatcgccctgctaacggatcttcgcaatattgcagcgtagtctgacccgggtacagtgcgtgacgaacgtgtgagccgtgtcaacggcaacattgaccttacagctttctgcggatgtgatgtcctggtctggctgactgcgatagcatttaagcacagcgatttgcagggtaatctggtgggattcgacagcatcgaaatcggtgagctacagcataggttgaattgtatagtcgatggattgtgtgaattcgaaccggtgaggaaccttttcggccgacataattagggcgcgaagtcgccgccatggaacgcgagcgaccgaaactaggcggagaagagcaccatatcgatattcggctacactcagtgggtggctagccggcctgcggccaatgtagttgccttgcctcaaaaggtttttcgcgatcgtcgtccaagaagttacctggacctagccagcatggactggtcaataaattcgagagtgaagcgtcgctagcaatcttcggggccccgaatcacctcgaccatcccgaagacgaaagtgttggcccgccgctcgcactatcgccgaccgtctggccaatgaaatatctgagtatcagaccggcatcaacgtagcggcagggccaggtcggagccagcaatgtcggcgccaaagaaagatttaagcacgccgtgatcggcgagtcggtcaacgaggctacccgattgtgcgagctagccaagtcacacccgggcccggtgttagcaacagcgatagcgctgcaacttacaagcgaaaacgagtgcgcccaatggcgtttaggtgagaccgtgacgctgcacgaacacggtaatcccacccaacctggcgtggcacatttgagccgccaaacctggcttacactcggcgaggcctagaaaatcagtccggagaacatggctcggtggaaatcatacttctgccgtacagcgctcagccggaatatattcgtgccaaagtgtcgcaacgtcagctggtcgctgccgacgggtccccggatgcttccacatagcacaacaccagcgcggattgccggcaccacggaaaagcggtggccccggcacaacaccaaccgaacgccatcgaggtcgtgcatgagcaccaacgcacggcacacaccatgcggaaatacctcgacaaccgaaacaatcttttaggcaacaaccgcgttgacggtgggcaagacatcggatagactaagcaaataccaaaagcgatgggggttgaggttccgccgtccagctacttggtcaggtccaagtaattggatggcatggcttttagaccctgtcagttgcacctcaatgctgaactgatgtcctccgccacgctgctaccctacctgaccggggcaagtcgcgatgatacggcaatgccgtgcccagcaggttgattgtggagtctgccagcgcccagctgctttggtcggcgatacgtaacctgtttggccaaccgagcaagacctgaggcgaacgcttgcggcgggaaattgaggttcaccacgtcgaagtccctggtggggaacgcagcaaaggtcaacgagattgttcccccgacgtagcagccaccgctgccgcgcaacgcccagagcaagccatcggggttgtgggtggcggatgcggtgaccagctggccactgaacagcaataccgataacgacgtcaatcgatcacagagcaggctcacatgtcgggtaattgacatccagcccctagggcgtgcggcaaccttgagctggtggcctgcggcgaacgccatcgccttttgcacgtccgtcgtcgatgtagcggtgactattatcgccggcaccgagccattgcagtttagtgttgaacacctgcttggccgctacgaattggagaccgtcgccgggtcgtaacacttttttcactgagggcggcaaaaagaaagagcgtctcaaacggaactgtttggaacggctagaacccggtccgaaccgactcggctcgatccaaaaactgcgccggagaccggtgctcccagcggcaccccacagaaacgtctgacgcgaaatctcacgccccaacgtcgggctcccccgatatgcatcatgtcccgcattgtccaccacccgaaccacggtgccgcatgatgcgtcgaggacaacgagaaacgtgcccaaccggttacctaacccgggccatcgcacgagctcactacgatcgtcgtttttccgccagttttgtcggtggttaggtgtaagtctggaagcgtgcatgacgatttcgaacgctgctatcgtgttgttcaatccaaggacacccaggtcgacggctagttcgtcaccgcggtgttgacgacccggatctactgtcggcccagttgcccagtcaggtccccgttcacccgtaaaattcacggggttctatccgggctgcggcggccgcccaacgcgcaggctttcgcacgtgcaagcggtaccgtaccgacgggtccccgagctccccggaatagaatgcacgtagtgacgtggtagccgcgcgggataatacgcggacggcacgatagactatgagggttgtcagcagcctagccattcgcgtcagctacaccacccgtcagctgcatcagcttttcagaccgatgtcgaccaccggcctgctcgcgccagctcgatcacaaagaacccagacagcccggatgcttatcaaaaaccacagacctgtcgtttgatgatgtcgcattcgctgccaaattttccagtatacgacagttcaacgacaccgtgacctgatcaccccgacgatgctgtaccagcgcgtagcggtccagttcgaagacttgaaagctatagccgattcaccgggaaccgcgtaactgctgctccccgtcagcacatcgtttacctaacagggtgttttcccaccggcgccatacctggatacgaggagctcggagacgacgcgaacccgaccgcagctggcgacttccctttggcagcgcactgataaccttaaaccgtggttgtcgatcatgtccgatgcctgtcgtgctcgacgtcgataacgaccccgacgtagtagtcgaaccgctcatcggcgaccccaacactgagtccggtggtagccaaggcgctgagacagtacatcctctgcactgtccaacgtcaacgaagttgaactccccgtacgtgcggtattaagcccacagatatcgaccaaacacacctgggtaggatgtttgctgcttacggggcgtttgtccacgatgccgacggcgtattgacccataccttcccgtcgatcgagctattcgtgaaaaacttggaaacgaagccaccaatacgattcacctggcggcgcctagaacccgacaacggacgccaagtacccttgctactcacatcgccgacagaagtgtcgtcttggccaccgactgcgattgggtaaagtgcacagagcgccagttgttagccttgtcgcgcatcggccggtagacctgcagggttgatcgcgatgcccggcatcggggatcccgacacctttcccgccagcaacctggggtttcggctagccgctcaacgactaggcctgcccctggacgaacggactacccatcgagcacagcgcacgttggcgttcctatggccacccaacacctctggaccacacccttcctccatccagtaaaccaatggccactaaaagaacatcccgaaagggggttgcatgattcattgccgtagcatggacagcccaatcggaccgttgatcctagccgggcacggttcggtcttgacgaatctacagatggtcgatcagacctacgaacccagtcgcgtcggctggctacccgagaacggtgcatttgctgaggccgtcagccaacttgatgcctacttcgccggcgaacttaccgaattcgctattgagttggatctatgtggaacagaattccaacaacgagtctggcaggctctgctgacaattccttatggggaaacccggtcgtacggagagatcgcagaacaggtcggggctcctggcgctgcgcgtgccgtgggattggccaacagcagaaatcccatcgccattattgtgccctgccatcgagtgattggcgcaagcggacaattgatcggctacggcgggggactcaaccggaagcttacactgctcgaattggagaaacaccaggtactgacaagtttgacattattcgactaggcatgtgcagaaaattcagggaataacaaaaccgcctttgacgaaaatgttttgtttatgttcggcagtgtcctacttttccacccgaatgggcagtatcatcggcgctgacaggcttagcttccgggttcggtatgggaccgggcgtttccctatcgctgtggccaccgtaactctataaaatttaaaaatttgttctgatggggggtgtgatgctccacgacaaagtggatctgaattatgtggttgcgatgtgtgtgttttgtaagctttcggccagttagtgccagttccctacactcattactgagcttctaggtctgacctatcaatcccgtgttctgcggggggccttatcccaccaagtgggtaagaaacctgatcttggagaaggtttcccgcttagatgctttcagcggttatcttgtccgaacgtggctatccagcggtgcccctggtgagacaactggtataccagaggttcgtccgtcccggtcctctcgtactagggacagatttcctcaagtttctgacgcgcgcggcggatagagaccgaactgtctcacgacgttctaaacccagctcgcgtgccgctttaatgggcgaacagcccaacccttgggacctgcttcagccccaggatgcgacgagccgacatcgaggtgccaaaccatcccgtcgatatggactcttggggaagatcagcctgttatccccggggtaccttttatccgttgagcgacaccccttccactcagaggtgccggatcactaatcccgactttcgtccctgcttgacgtgtaggtctcgcagtcaagcccccttgtgcatttacactcgccacctgattaccgaccaggttgagggaacctttgggcgcctccgttacattttaggaggcaaccgccccagttaaactacccgccaggcactgtccctaaaccggatatacggttcgaggttagatgttcaatacaatcagagtggtatttcaacaacgactccaccccaactagcgtcgaagtttcacagtctcccacctatcctacacaaaccgcaccgaacatcaataccaagttgtagtgaaggtcccggggtcttttcgtcctgccgcacgtaacgagcatctttactcgtagtgcaatttcgccgagtctatggttgagacagttgagaagtcgttacgccattcgtgcaggtcggaacttacccgacaaggaatttcgctaccttaggatggttatagttaccaccgccgtttactggggcttaaattctccgcttcaccctttcgggttaacaggtcctcttaaccttccagcaccgggcaggcgtcagtccgtatacatcgtcttacgacttcgcacggacctgtgtttttagtaaacagtcgcttctcactggtctctgcgaccggatcccgctcccaccgcaagggtgttcacgatattccggccccccttctcccgaagttacggaggcattttgccgagttccttaaccatagttatctcgtacgccttggtatgctctacctgaccacctgtgtcggtttggggtacgggccgcatgtatgctcgctagaggcttttcttggcagcagaggcttaccgaattcgcctcaatcggctatgcatcacctctcaggattcacgaacgacggatttgcctatcgctctccctacgggcttgctccagtattaccactgactggtacggctaccttcctgcgtcaccccatcgcttgactactaccaacgaagttcccacgcagccccgaacctccatagcccccgaaggggatatggtcgatccggttttgggtggtgagtaccgctgattcatcacgggcgcacacacacgggtacgggaatatcaacccgttgtccatcgactacgcctgtcggcctcgccttaggtcccgactcaccctgggcggactggcctggcccaggaacccttggtcttacggcgggcaaggttctcacttgccttatcgctactcatgcctgcattctcacttccccaccctccaccaccggttacccggaggcttcgctgaatgaggaacgctcccctacccacatccaccctagaaggtgaatgtgccgcggcttcggcggtgtgcttgagccccgctacattatcggcgcacaatcacttgaccagtgagctattacgcactctttcaagggtggctgcttctaagccaacctcctggttgtctttgcgactgcacatccttttccacttagcacacgcttaggggccttagccggcgatctgggctgtttccctttcgacgtacggagcttatcccccgccgtctcactgccacgcttttaaaccacggcattcggagtttggctgacgtcagtaacctagtagggcccatcggccatccagtagctctacctccgtggtgaaccacgcaacgctgcacctaaatgcatttcggggagaaccagctatcacggagtttgattggcctttcacccctacccacaactcatcccctcaatcttcaacttaagtgggttcgggcctccacgcggtcttacccgcgcttcaccctggccatgggtagatcactccgcttcgggtccagaacacgccactacacacgctcacacgtgatacgccctattcagactcgctttcgctgcggctaccccacacgggttaacctcgcgacatgtccctgactcgcaggctcattcttcaaaaagcacgccatcaccccacaaagaggctctgacggattgtaggcacacggtttcaggtactatttcactcccctcccggggtacttttcaccattccctcacggtactgatccgctatcggtcatcgagaagtatttaggcttaccgggtggtcccggcagattcacagcagattccacgggcccgctgctactcgggaattgatacaaggcaggtgccaggctttcgcgtactgggctctcaccgtctacggcaggccatcccaggccatttccgctaaccacggcactttctgactacccctcaaccaggtagagttgagacataccaatcccacaacaccgcacacacaacccctacctagttagacatgtgtgcggtttagccatattccacgttcgctcgccactacttgcggaatcacaattgttttcttctcctacgggtactgagatgtttcacttccccgcgttccctcccgaaccctatatattcagatacgggtaacacgacatgactcgtgttgggtttccccattcggaaatcctcggatccacgctcggttgacagctccccgaggcatatcgcagcctcccacgtccttcatcggctctcgatgccaaggcatccaccatgcgcccttaggcacttacttacacacaaaaccaaagaagaaaattacacattttcaatgaatacgccaccactacataactgacaacgcatccatttagatgctcgcaaccactatccaatactcaaacaccacaccccaccaccaaagatgagggacaacacccaatcaagccgagtgttgcctcaggacccaacagtgtgtctggatatttgctgttgcgcacccggctctcatccactacagatgagaacccctgacggcttacaccctaaactatttagagtgtttttcgtggtgctccttagaaaggaggtgatccagccgcaccttccggtacggctaccttgttacgacttcgtcccaatcgccgatcccaccttggacagctccctcccgagggttaggccactggcttcgggtgttaccgactttcatgacgtgacgggcggtgtgtacaaggcccgggaacgtattcaccgcagcgttgctgatctgcgattactagcgactccgacttcacggggtcgagttgcagaccccgatccgaactgagaccggctttaaaaggattcgcttaaccttgcggcatcgcagccctttgtaccggccattgtagcatgtgtgaagccctggacataaggggcatgatgacttgacgtcatccccaccttcctccgagttgaccgcggcagtctctcacgagtccccaccattacgtgctggcaacatgagacaagggttgcgctcgttgcgggacttaacccaacatctcacgacacgagctgacgacagccatgcaccacctgcacacaggccacaagggagtgcctatctctagacgcatcctgtgcatgtcaaacccaggtaaggttcttcgcgttgcatcgaattaatccacatgctccgcgcttgtgcgggcccccgtcaattcctttgagttttagccttgcggccgtactccccaggcggggtacttaatgcgttagctacggcacggatcccaaggaaggaaacccacacctagtacccaccgtttacggcgtggactaccagggtatctaatcctgtttgctccccacgctttcgctcctcagcgtcagttactgcccagagacccgccttcgccactggtgttcctcctgatatctgcgcattccaccgctacaccaggaattccagtctcccctgcagtactccagtctgcccgtatcgcccgcacgctcacagttaagccgtgagatttcacgaacaacgcgacaaaccacctacgagctctttacgcccagtaattccggacaacgctcgcaccctacgtattaccgcggctgctggcacgtagttggccggtgcttcttctccacctaccgtcaatccgagaaaacccagaccttcgtcgatggtgaaagaggtttacaacccgaaagccgtcatcccccacgcggcgtcgctgcatcaggcttgcgcccattgtgcaatattccccactgctgcctcccgtaggagtctgggccgtatctcagtcccagtgtggccgtacaccctctcaggccggctacccgtcgtcgccttggtaggccgtcaccccaccaacaagctgataggccgcgggcccatcctgcaccgcaaaaagctttccaccacaagacatgcgccttgaagtcctatccggtattagacccagtttcccaagcttatccctgaagtgcagggcagattacccacgtgttactcacccgttcgccactcgagtatctctaaaaaagattttttagagacctttccgttcgacttgcatgtgttaagcacgccgccagcgttcgtcctgagccaggatcaaactctccaaacaaaaactccatcaataactagacgaaattttcaatttctagagatacctgacaagacaccaaaactggcatctataaataacataataaactacacctacacacacgaggaatgctagatgtagtcaaaaaatcaacaacaacaaaaccaaacacactattgagttctcaaacaacacttcaagcttacttcccccgcttcggggcaacccagccagattaatactg

SEQ ID NO: 124 - DNA (genomic), 36033 bp, MYCOBACTERIUM LEPRAE; double-stranded, circular
  hypothetical: NO
  anti-sense: NO
gactgagacctaacccgccgcgctggccaaatgtccagagcggcggtagccaaataccgagtcatcagtcagccggcagccggtgaacgcaagtttgcggatgtcctgtgggctgtttgcaacgtgaacagtggacgccgtccgcatcaatgatcacaggcgttcgcggcctcaggatcagccgcggcggcaacgtcaactagatgcccaacccagtcgaccagctgtccggacagatcgacacacatcaattaccaccaagaccagtgactttttcggcactaagccaagaacggcctagtagcacggtgatcaatgctccgaaacggtttaactcaaaattgggtggaggctttgtcataagcatcaacgctgacgatcgccaccgtcaaccgatgttcatgcggcctggtggagctgtccgcttgtgggcgaagttctgactgtgcgttcctactgtctatattcatagggtcaatgtgcgagtacgactatagtgattattggtttatagtgattattggttcgggtcctggcggacaggaaaaccgcggtcgccttcagccaagctaggtaaatccaccgtaagcatcgaacgtagccgaataatcggcagcgtgcatgtcaaccaccggcaccatcccgtcaaagatattgagtgaaacggttatttacctcaccggaacacatcagggtgagctatacagaggaagctaccagtaaaatatcggagcacttcagctgacctgttagctcgaatcaaacacgtgataataaagaaaattaacataatacgcagccaattgattcgcaaccgggtcaatttgctgctcagacacagccgcttcctcgattcacacacgattctcggtgaagaccatgaccactgcaagaagaccaccgtcagcggctataacgtcgtcagcagctaccagcaccaagttcggtgcggcctgctggggtcgagttggactagaaaagaattctcgactccgatgggatcctcgacctcaagtcactgccgtcctcgatggccgtggtcggtgccggtgcgatcggcaccgagtacatttcgatgtttgccgcgctggtcaccaaggtgaccgtggtggaaaagcgtagcgacatgctggacttctgcgacctcgaagtcgtcgaagcgctgaagttccacctacacgacctagcagtgacattccgcttcgacgagaaagtcaccacggtcgatggcggttcgtcaccactctggtcagcagcaagcagatccccgccgaatcggtgatgtactccgcggggcggcgggatcagaccgatcacctcgacctggaaaaggccgacctgtaagccgtggatcgccggatggattttcgtcgacgaaaaattctcaaccaaggtgggccacatctatatttatttctatgccgtcggcttacctgcactcgccgcgacctcgatggaacaagggcgcctggctgcctatcacgcatttggcgagctgacggctagacatcaccaaactacagtcagtcgatcggcatgtattcaatcccggaggtggcctcatcggcaccaccgaggtggaactcacgcaaaactcgatcccctacgaagtagggatagctcgatgccgcggaagctggctctcagccagatctccgggacttctacggcatgttcaagtttgcttgtccaccgaagatctcaagctgcttagcgtgcatatcttcgtcaccaacgccaccgagataatgcacatcgagcaggccttgatggggtgtggagacaccgtcgagtaccgggtcgacacggttttcaactgcccaagattctccgagacctacaagaacactgcattagaagttatgaacaagatgtgtgcgctcaaccagttccgccggtgatcatactatcctcaaacagaatatcatcgaattcggacagcacggaatcaccgggtccgtcggcttgtgcgcaccagcagctgcgcgatgtgttcatcgaacgatgccgagtacgacatgttctgcgcgcacccaccaccttggagaccaccaaaccaatccgatgaccgccgatccactcacccatggagcgccgctggtgccgctgactagcccctcacacgccaacaagggaaacccgctcgcggtgatcccggttctggcctcacagccgataggtatgctgccctgggcaggcgccgtgcctagtgaaagcgcggagccgacatgcgattccaccgcaccaccaccagctaactcgggcaatcacttagtcggcacgcggatcctttatggcaatccaacgtggatctatggcaatccaacgtggatcgaagtagaactggtcgaccttccacaagtcggtgggcgcagcatcatcggttaacccaggaacgaacgttgcctgggaacgcccggacacgcagtgcgcggcagtcaacacaaggtcgccgcccgtcgagtgcaccaccgagcctgtgcaaacctgcatggcgccgccgtcgacgaagattgcaccaacgcgggtcggggtccaccggacccgccacctgctcgggctcgggtcagctatcctgcggtattagcgcgctactcggctgcactggtgcggggggacatgtgcgataagctggccgtccacataacttcagcaacgtcgctaggctgaacagcaggcaaagtcacatcttcccaaccctcatcgctctatatcattcctgactgcgcaccggccgccggaaatcgacactgcccaacacaccaacaagcttgccggcaaattggacgccacccgctagtctaccggcgcctgccgtctcacgatcatgcgctttcgaaaaatcgctgtcaggtaggcttggttgttcacattatcgggtcgccgtcgttttgagggacactggttacggcaccttggacagacgcacgagagaaggcaacaccgatgtcccactcccactatcaagacccagatgacgagcagcactaccagccagggcagcccggcatgtacgtgcttgagttcccggcgccacagttgctggcgtccgatggccgcggtccggtgttgatacatgctttggaaggcttttccgacgccggtcacgcaatccggctcgccgctacccacctgaaagctgccttgaacaccgagctggtcgcctctttcgcgatcgacgaattgctcgattaccgctcgcggcgaccgctgatgacgttcaagaccgatcacttcacccattacgacgatccggagctcagcttgtacgcgttgcgtgacagcgtcgggacaccgtttttactgctggccggtatggaaccggatctgaaatgggagcgtttcatcactgcagtgcgcctgctggccgagcgcttgggggttcgacagaccatcagcctaggcactgtcccgatggcggttccacacacacggccaatcacactgaccgcgcactccaacaacggggagctgatcgccgatttcacaccttggatcaccgaaatccaagtccctggtagtgcgtccaacttgctggaataccgaatgggccagcatggtcatgaggttgtcgggttcaccgtgcacgtgccacactatctgacccagactgactacccagcggccgcccaggcactactcgagcaagtggccaagacgggtgcactgcagcttccgctatcggcactagccgaagcagcggcagaaatccgagccaaaatcgacgagcaagtgcaggcaagcaccgaagtcgctcaagtggtagcagctcttgagcgccagtatgatgcgttcatcgacgctcaggagaacaggtcacttctgagacgcgacgaagacctgcctagcggcgacgaacttggagcagagtttgagcggttcctcgctcagcaagcagagaagaagcgcgacgacgacctgacctgaacgccctgatcagatcagattggcgacatgaccgtgcgaaaaagcaatcttcgcacggtgcgaaaagtcactacactgccgttgcgtttccgcatgatccacgtttacaagcgagcctaccgcatcgccggttctagtccgacgatactgctgatccacggcatcagcaacaattccactcgctggactaccgtgcacgccaagctcgcccagcagttcacggtcattgccgaaaatctatctgggccactgccagtccgataagccatgctccgactactccgtcgtggcatacaccaacaagaaacaagatgagtaggctgtttagcgtacttagcatcaatcgaacaaccctagtgggtctattcactcggcagcggtgtggccgatgcagttcgcctaccaattacctcaggtggtcaacaagctcatcccggtctccccacccacggcgtcgaccaaagatgtccccttcgtcttccggtgtgcattgttgccgatgggcagcgaaactctagcatttctgcggctaccctgatgctatcggcggtgcagctagccagccggtgttgggcatggcgatcaaacgaccggcttgggtcgcgagctaccaaatgtgctgcagattttagctgatctacaagaaccgacggcctcatcagcgttcggccgcaccacgcaggcagtggtcaattggcgcggctagatcgtaaccatgcttgatcgatattatttgacccaggccatcccaatgcagataattaagttggagtgcacatgatgtgtatggtaccaatccgtcacgcttggatgacacacagcgcgatgcctagttccctactgaagatctttgaaggagctagccattgcccgtttaacgacaacccgcgccatttcaccgacgttgttcagcgcttcctcgacgccaccgagcctgccgaatagaatcaggccgctctgcgtgaattgctccgcaccggcggcggcaagcgaaccgtgaccagctcggccaaaacccacgttgcggtgctaaacaccatagcttccgacaaacgcagcgctgcctgagcaacccagccgcacgctcgtcgtgcaggaccgtaaagtcgagccgtgggtatcgaacattacggtattgcgggttttcaccgatgcagatgtaaattccaggaatccactcgatgtagttgacgttaggcaagtacaaaccggggatcgggaacacctggcacccaattgggctataatgaaacgatatttgtcgacctgcccaccgccgactcgactaccgtgcacacgtccatccacactgcggaaccgaactccagttggccagtcacccaagcagtcggagcgtcggtcatgttagctgcgtgccaacggtatgccaatcaacactctgcagatcccggctagcatcgcgcaggtgaaacgaaagtaccggtgcaccaagccaccgtaccaggatcagggcacgtgcggaatgagctcccgaattcaccatccacaacttcgactcgctcggtccccttggctccgccaaccccgccgattttcccgacgacattacacactacctgtgggcctggggcgatcggtcaagcccgatagctgcgtgcgcgaatgtttgccgcccacctaggcgtaccggaaaacgaaaagacgggctcggtggcgatgcagattatcgactcgactacctcagccacgatctgactaatcacccagggcaagagatctctgatcacaaccaccttggagtcccgaggactgagctcaggtagcaggccaagtcataaaaacgatgtgatatgcctggactgatcgcggccggcgcagcgaacccagccgaccagcgagagttcattgctttcggtgcaacacggcgacgaggtgatcctgcaggggttgccccactgcgcccatctgcaccgaatatgcaaattcgtcgccatcgatgcggaaaaaacgaccaagcgcagtcacctgtttggcggtcggaaccaacccgatcgttgttgtgaccaactcaacttcgatgagatcgccggtcaccgaatatgtacccacttcgatttccgcaatatcgctgtgatgggcgagaactagttcgatgtgacccggttgcggcacacgaaggtagcctgtctcagcatgcaacggcttcccgtcggttattgccctggtcttctgcgtataagtcaggaagggtctatccagatgggaaaacacaacttcctcgaggtattcgaacggctggatcgtcgggtactttcccatgcctcgaccgacccacgaaccaagcagcggtgccagtgcctgaagatcagggcacagatcggaaggcatgcagtcagcctaatgggaaccgagccatccactgcaatccgtcagcgtgaagtggatactctgcggtgtgcgcgaagcgcctcaatctcgcgctcgaagtcgtcggccgacgaaaaggatcggtataccgacgcgaaacgcaaataagccacttcgtcgagttcgcgtaacggcccaaggatcgccaggccaacctcgtgacttgggacctctggcaaccccgcagcacgaacggtgtcttccacctgctgggccaagaggttcagcgcgtcgtcatctacttggcgaccctgacaagcccgacggacgccgcgaatgaccttcccccggctgaagggctccgtaacaccgctgcgcttcacgacggccaccacagcagtttctacggtggtgaaccgccgcccgcactctgggcacgaccgacggcgtcgaatcgcttggccttcatcagtttctcgcgaatcaatcaccctggaatcggaatgcctgcagaacgggcaatgcatgaccgctcctttgccgggctgatgtcaaggtatcgcagacgttccgagaatacctgtcactgccccaaccaacgaatactgccgccacacatgcgcgttcatcgccacaaacaccgggtagctttgcctttgggcggtttccgcaatacaccaagaagccgtcagccaaccggagcgatcagggtctggcccgcgacgagcatcgacgagtccaggacgttaagttcacgaatgcgctcgctcacttggcgaactggtgcgtcgggtgctacccgggcagccacgtcctgaagcgactctccggcttcaacccgcaccacggctagcctgtttggcacgtgagtgacaaaaccggtggcgtcgccatcgatcacctggctgacgtcggccattaaaccgagccacaaggtgatcatcccggcgagcaaggccagcccgatcgttttcgcgagtgaaacggtacgcccacgatgtggggcgaccaacatcgcgacactagcgccggagtagcgcatcggcgcactcgctgaccgcgacggagccggcctgcgagatccagccgactcaccgctgccacaacgaggtccaagaatcggtcggctcatcgggtgccggacattcccgataagcggcggtactgcgtagatgactagcatgtgcgttcctccgatcaacaatttctcgctcgtgcgttcgacattaatcgatcatatgttcgatatacgaacattcgatcgaagcgtgtcgggcgtgtatgcacgctagctcagaccaccgacatttagactttgcccacttgccccaagctgcggcagggaatccaatacctatccgccgcaatacggtcttctaggctggcggacgatcccgctcccgcaacacatttgtcgaacacatgtttgattctccactgacatcggactacattcagtggcatgagcgacagcaccgacatatcaggcatcaccgtcgacggccgcttgcattctatggattcagggctcaccgagcggcaacgcaccatcctgaacgtcatccgggcctcggtaaccagccgcggatacccacccagcatccgggaaatcgccgatgctgtcggtctgacgtcgacatcctcggtggctcaccagctgcgcacccttgaacgcaagggctacttgcgccgtgacccgaatcgcccgcgagctgtcaatgtccgcggcgtcgaagagactcaggcagccggccccgctgtactcaccgaagtcgctggctcagacgtcttaccggagcccacctttgtcccgatcctcggacgcatcgcggccggtagtccgatcttcgccgaaggaactgtcgaggacatctttccgctgccccgtgaactggtcggcgagggtacgctctttttactcaaggtgaccggcgactcgatggtcgaagccgcgatctgcgacggtgactgggtggtcgtacggcaacaaaaagtcgccgacaacggcgatatcgtcgcagccatgattgacggtgaggccaccgtgaagacgttcaaacgcgcaggcggtcaggtgtggctgataccgcacaatccagcgttcgatcccattcccggcaacgatgcaacggtgcttggcaaagtcgtgacagtaatccgcaagatataacccccgaaaagtcttgtgcgtagtcgaccggaccatcgtcagtcggccttaataaagccgttgacctgggcgatttcttcattggctagccagacttcagcgagcgtgtcatggtataattcgctcgccggggtatagtacagaccgaagcgcggactagctttaataggataaccgtcgggtacctgataagggtcatccaacggcaggtggatcgtcggccggagagtcgggcttggccggaacagcatcctcggcacagtgacgcccgggaaggacgcatccatcgcatctgccatatcaacggctgcgtgtcgacccgtgcttacctcagtgtcagcagcagtttccaacaaactactgttgtcagtggcgacactactgttgtcagtggcgacgacctccgcagcatcggcatcccagtgtgctgcatccgacaaagcagcatatggaaagtcagcatcagacagagccggcatagaatccgtatccaccgcgtcgggatcatcctcttcaaggcctaaaggctcctcggactcggacggcaattcgctgccgaacgccgggccaagcctagcatcctgagccaggccggtagcgtcctgtgctccacgcaaccaactgaccgtcggtccgcgttcgacatcacgcaccggatgctcggtaccagactcggcgtcgtaggtacactgcccatcaactgcggccttgtagccaaagtccatgccaacgtccatatcgtggtcatgggagtcagcaacgatatcgtgagcggtgcgacgccgacgccacccgagtgctagcaagacgaacatcacgatcactaacagcacagcaaccgcagccaccaaccaccaccaatgcccggtggatttcttggcgtggaatagcatcgccaactcactcggttggctctgctcggacacctgcagaccagacaacaacgacgctaagttcgccggatcggcagtgaaggtgttattagcgcggttccatgagatcttgccaccgataaatctctgcgagatcacattaccatccaccgattggtctgctaccggcacgccgagtttgccgttgggacctttgagtttgtcccacgccgccttcatcgctccgcgcacgacaaacgcgccgtggtcgggtgtccaaaaaatcaccggcttatcggctgcggagaaaatggcgatccggctggaggtaacgatgcccccgtctccctcgttggcggcggggaaacccaagtcgctgccgaccggaccgcctagagactcatacttagccagaatgtcattctcgaccgcattagcaccggtggctttgctgaaaaataccttgccaccagcaaagtcctgaataattccgtcagcaccgatgggatgctgcccgccctgcttggggcctagcggacccgaaacgccgccggccgcacgccaggccatgctgatggccgtggtgggatcggttgctaccagcaatcctgttagctgctcggctagtgccgttggctcggtggtgaactcgctgcttttcttgttccaaaagactgcgccaccactaaacttctgggagataacctcaccgtcgaagctttcatctgcgaccgggacaccgaggacgccggctgaactgccgagtttgtcccacgccgcattgagcgcaccacgcacaacaaacgcgccgtggtcgggcgtccaaaaaatcaccgggttgtcgctggcagcgaatatactaactcggctgtcgggtccagctagaccgggaacttcgtcgatgattgggaatcccagatcgctgttgaccggaccgccgagtgactcgtatttacctagtactggcccatatagcaacttggcgccggtagccgtagtgaagaatagtttaccggacgcaaagttctgtgcgaaaccgtcaccaagaggatatacctcgcccttcttggcgccaagcaccgaattgtcaccaccggccttgtgccacgcggccgtaatagcatcgtcggcgtcaccggtgggagatgcagtcacaacaggcgccaacaacacagtaaccaccgctgtggtcgccgtgttggccagcgccctccttacccgcttgctcactcgacctctctgctcgttcactaagtgtcttccagctaaaggacatgcccgatcctgtggtcatgcccgtaccctgcccaacgagcgggttcacccagtacagcccgtattatcgcggagcccagataactttgctccagcaaacgatacttgcgaagttaaatcaaaaatattacaataacagataccgagtcgatgtcgaaatggtgctgtcccataccggtgtcgaagccgatagcgcagcaagccacaccatattgggattatcgagctcgattttaccgccctatggatgccgaacaaagaaacaacgtagttaaagtgggtatttccagagttacctgggcgctcaccaacgttgtggtcaccggcttgctgctcagccccgtcttccacacaactttcccctaaatgagaagcatgtgccgacactaacgttagccatgatagttcgatgatcgggctcggggtcgcagtccccggctgctgagcggccggcctcggcaacccaaccatgtcaccatgcggtatgtattggccatctcaccgaccactctataatccgacgtcgacatcatcttcgtcgacacagcctcaagctactgggaggtcgacgtgcccgactaaatggctgcgctcgacctaaccgaacccaccaaatacatatctaggactgcacacctagaatccagaatcgacgtcatcgccgccaacgaaccctgaaccgggccggttccaagctccactacatcagtgcccacgcgcctggtggacactaccgttgcggtcgtggtcaaccatggcaccctggacgatcctcgaacctttcaccaaggtgatcgtgactgagcatgaactgcgcagcctcgaggagccctccattgtcaatggcactacgacggacccaggctgacgcccacgaagtcggacccagacctaaataatgttgtagagaaacaatcctactgtccaggcgaagaagccgagcagttcctaatgggtaccgctgccatcagcaacatccgcctggcgtctgaactggacatgctgcttaagttaggggccttaccgcggtgaggaagtgttggtcgaggccccgaaaccagacggttcgcctttggctgccttgtgtttcaaccccgcagtaagacagcctttgatcaggtgcaattcgacctcagaaatggtgccttttaagccccagcaccagttgattattgttgaaatcagccagatgataaaccccgcccacgattagcgtatcggtgatcgcgcacaagtccagcagttgataccagtcggcgttatcgaacagaagcaacaaaagttagcataggctcactatgactacaatacgcgcaagtgattcaccgctcttgtgatcgtgggcaggatccggaacgaggtgaatctacttattcctttatcaacatagtcacgcaacgcgtgactcgaaaagccgctgcgccaggcggtgcagcttcctcaaatcggtcacgaccaacacccacaccgcgccctccgccaccaaagacatctgtcgtatccgcgcgtatggtgcctagtgaacccatccggcagcgacaccactagatagtaacgccccgttccatcgcttaaacaaccgatgcatctctgcaacaacccgctcttcacgcggcagggccgcacgcaactgttacactttgtcaccatcactaccggcacagggaagagtcaactactgatcagccgcggacacgccactatacactatataagtcaactgggttcacggtccgctacttcaccgtagtcaaccttattgaagctctctaccgcggggctggccaacaacatcatagacaaaaatcatcgacacgctgcttcgctccgacgtcgtgactctcaattaaatcagcttcgccctactcgatggcaccggcacccaactactttttcgcttgttagccaccggttacagccgtcactcatagccgatcgcctcacatcggcccttcgggcatatttggggacggttcctgcccgaacacaccaccagcatgctcgaccacctactacactacaccactataaaacttacttagtcacttctggtgagtactaccggatacgccacaccgaccacgagaagtagagttgccaaaccgagttagccaatcacccgtgtcgaggtagggacttttcttggccaccagtggtgacatttacatggccactgacaccactaccgctcattaccaccacagcgaagcattctactaactcgtcaatgcactctagaattacgtaccagacggtttataggggtaggccccggagggaattgacagaacgatcagtgtcagccattaaggagctggcgcgttgcacattttggccgtgggcattgacctgctcaataaatcatctggaagctgcggtccaaatcactgacgaactgctcgcatggtgccgaaccttatccgtcgcgaaagttagcagtataccacacacttgccaggatggcctgatgcgtggcctccaacaacaccgcttgaacgcggctaatcgcgccatgcacgtcgaatccccgaactagtagttcaaactcgccttccacggtcgtctgggtggtcgtgataaagtacagatatgttgtggtcattgtggaaccgctggcaatgacctgcgacaaattcggtgtcggttggcacaggcagaatgaactggtcgacgtcccacgacgaactcagtgccgcatgcgagtgctccagcagcaccggcacagtcggcgttttctcccccattcccttgaagacctcaagcctgtatgtcgtccttctatttcgtcatcacgtccgcgttgcgggcccacatctcttggtcggcaacttcctcacacgcaatctcggcagtgaaaagccccgagtaggtcggctttcttactcgctgtgtccctcaggcagttcgccagcaccaccgacaccatcaagatcaagttgaccgccttgtcgtggggccgccacttcaacaaggtaatcggcgaccctagtggcaactgcgacgtgttccactagccagcgcctgtatccggtttgccaagtctgaaatcggacatgccgcatcaccgcgcaaaaactcattcactatgatgactttggcttcccattcctccgtcaactggcatagtcttccggaagactatgccatgccgcttgagcggaacgtagcgggcccaaacccggactacgaaatttaacgttaatgtcagaccgtattgtttggaagttaaataccttgttatttttctcctaaaatctaataatgcatatcgctggcagatctattcgccggtagcaatccgtggcagccatagctaagatggattgcggtcattgtcagtttcttcaaagccctcaatgatcagattcttgaaaacccttatcagggtcctcataagtctttgcggcagccatcacaccctggccgatctgccttgccgacatccgcacccccatctgtattaatttggtacagttgcccacgggaattaaaaatctcgctaacaaagctggcaggctctcgacggggagccttggtggtcactgtgaccttcacggatatcgactgtcgaaacacagtcagcaagctccaccatcttggtgcttacgaaagtgatagcacctaacttcatcaccacatcacttgactcatctgacagacgaatacccgtcaccaagttctttgattctgtgcccacactcaatcactaacccccccaaaaaaagatcggagagtgggccaccaggtgaacactgaagaactccaaaaccttggcctacacgataacggtgacgccaaaggacacaggtgctaacccacgatagcccagttcggtatatgacgtcggcgacgataagtcttctgatcgatggttgtcttgctgtgccggctgttgggaggatgcggcggttgcaaactaagaatccacgccttccagaaccgctgctacattttggtagccaaaaggtgggcaagcagtgtgttgacgatgcagcagagttcttataagtagttatgggtactttggctgggaatgtggtcgctggaaagccagcgatcacaccttcgtgccgatgaccatcgatgggtgagaatataccgcattcgccatcgacgtctacaccgggtttgatccccgactgggaatgcttgcggaccaaaaacaccgcgttcgtggagcgtgcgctgcaccatgcaaccacctaccctgcccggcagggccacccgttcaacaatgcaattaaccgataggataaaataagccaattactttgcaacaatttcgccgatccactgatatcggccggttcgatcccgtcgctaggtaccgtcggtaacgtctacgacaacgcgctgcgcgaaaccacgctagagctctacaagaccgagtgcatactccatgacaacccatttcgtagcgtaccaatccaaaccctggccgacctggcagataccatctccgcataggtcagttggtaccaacacagcccgcttgagccaacggccgcccattggatccgaacccggtactacgatcaactccgggccggaaaacacacgtgatcacacgtaacgatagcgtgcatcaaacccggttcgcttgagcaaactcgcccaaatcgccgaaccacacaataacacaacccaagtctggccatcccacatctatactggccaacatagaaattatttggtccatgttccaactatctaaggaagtcgggactagcgacaagaagaattgcgtaacaatttatttcatgatcagtagcaacggaagattgaaactagctgaaattaaaattggtgtccgctagacacggaggctccggtcgataatctccttcatgatctcgatggtccttccatacttcgcctgaaccaaggtatcgaaataggcacggtaaactaggtattcgctcatgtagccgtacccgccgtgcagctgaaggcaacggtcgatcagttgtggctgcttctctcactggcacacaacttcaccattgtgacctgttccgcggttagctccttctcgaggtgcagatggatgaagatgaactcgtcaaccatcgtgcgcatcacgatggcctcagtcgccaacccggccagtacgaatcggctgttctggaagctgccaattatcttaccaaaaagctttgtactccttggtgtattgcaatgtctgttccagcatcctattcatcgccaagctgccatgattgcaatcgaaatccgttcctgctgcagattctgcatcaggtagattagatggaccccaccctctcctaaccaaacagattttccgtcgaaacgtggacgttggtaaacgaccgctccgcggtgtcccacgcgagcggtccgattttgtttaaatggcggccgcggtcaaagcgctccatgctgtcaagaagcgaaagaacctgcacgcccttattcgagttgttttgcaccattacgatcaccagatcgacttgattccgttgatgatgaacgtctttgctccattgagtatttagtgatcaccctgtttgactgcgcgaatcttgatatcctgcaagtagctgccaggtcccaattcggtcatcgccatcgcgctgatcagttccctgatgcagaccttggacaaccagcactgtttttctcctcaacaggcagacacagcaggtgcgaggccacgatgtcgttgtgtaagccgaaaacgatgccgctgtaacccctcccctcgacgttagtttcctcagtaatgatcgtgttgtacagaaagtccgggttaccgcctctatcgtactcctcggacgccgccaccccgagaaagtcctgtttgccggcctcgagccacaccacctcgatcgacgatcttcaccttcctccattcgtcgtagtacggcgcaacgtagcgatcgaggaagccgcagtagaactcacgaaacaattcatagtcaggctggaaaagtgcgctagtacttaatggcaccactcatgacacgaccctccagcgaacaggaacttcgcagcccaacgtgcataaaccggatggttggtcaacaacttgccgcccgacccaccaactggctaaccaagcgatgcgtcgcgtaccggcggggatgaagaacccggtgacatctgaccggcaacagctatcggtcggccgaaaactcctgtaagcaggcggccaacgccacgggaacccgggccttgatccgggtgccgttcgaattgtgctctgcctgctgaacgcgcccgttagcgtgcaggcgagccaccagatcaccacggtcgtacgggatcaccacgtctacagcggtgtcggtggccacaacgagctcggctatccgtcgccgcaacacgtcgataccgtccccggtgcgagcggagatgaacacggcgcctggcaacccgtgacgaagcttggccaacatcagagcgcttgcggcgtcgatcttgttgaccaccaacagctcatgcggcacctccacgccaccgtcctggtgatcggaaataacctcaaagatcacctgacggacagcattgatctgagccaacgggttggcatctgagccgtcgacgacatgcaataacaggtcggcgtcaacgacctcctccagtgtggaacggaatgcttcgaccagctgagtaggcagatggcgaacgaaccccacggtgtcggtgaacacgaacggctgaccgttatcgaattctgcgtgccgggtggtgggttctagggtgacgaacaacgcgtcctgcactagcacccacgccccggtcagcgcattcagcacactggacttgccggcattggtatagccgacgatagcgatcgacggaatgtcgctgtgcaaccggcggctgcgctgggtgtcgcgggcctgcttcatagcgccgatatcccgacgcagcttggccatccgttcccggattctacgtcggtcggtctcaattttggtctcaccgggacctcgcaagcccactcctccgccactgccaccggctcgaccaccaacctgacgtgacatcgactcaccccagccgcgtagccgcggtagcatataagccatctgagccaacaacacctgggctttgccttcccggctggtcgcgtgctgagcaaaaatgtcaaggatcagcgcggtgcggtcgatgaccttcaccttgaccgccttctccagcgcggtcaactgcgcaggggacagttcaccgtcgcagatgacggtgtcggcgccggtggccagcaccacctcacgcaattcagccgccttgccagaaccgatgtaggtcgacggatcgggccgatcgcgacgttggatgagaccttcgagaacctgcgaaccggcggtttcggccagggtcgcaagttcggccatgctggcctgattgtcggccgcgctgccctcggtccacacaccaaccaacaccacccgttccagccgcagttggcggtactcgacctcggaaacatcagcgagttcggtggacagcccggcaatccggcgcagcgccaatcggtcatgaagggcaagctcaccggtgctaggcaccgagtctgacgagtcccagagatccggaaagtctgcagagcccctatcggacgaatctggatatttcatagccagtatccgatggtggcacttcgtagctgggcgcgcatccgaataaattcccgcaacatttaacagctgcgcgccaacgagtaccaccaggcgtccgcgagctcgccgtgcgccactaacaccgatggtccacgcaagtagctggtcacgtcagtgatagttatgacaacgtcgccacccggcaccctcacagtaagcgtcccggtgtcggcgccagcacttgccagcgcagcgaccgcggccgcgacagttccggtaccgcatgaccgagtttcacccaccccgcgctcgtggactcgcatctggaccattccgtcgaccggtgcggtgagcacttcgatattgaccccgtctggaaactgcacacggtcgaggtggaccggcgcacccaagtctagagctgcgagctcttccaaactcagctgcggatccatgcacgccaggtgtgggttacccacgtctaccgctacgccggaaaatcgcctcccgccgacagtaaccgcaaaggccggccccccactgcccagcaagtttgccttgcccatgtcgactgtgacgtcggcgttgagctcgtcgacatggtgcacgttaaccagtcgcgggccagccaatgagccaacgacgaactcatcgcaagactccaagccgctggcgcgcaggtaatgcgcgaacacccgcacaccgttgccacacatctgcgccaccgacccgtcggcgttgcggtaatccatgtaccagtcggagcagctgacaccgtcaggcaggtgctcgagcacaccggccgtcactgctgcgcccgcggtagtcacccggagcaccccgtcagcgcccagtccttggcgccggttgcacaatgcagcgacctgggcagcggtgaacgtcacatcagcctcgacatcaggcaacaccacaaagtcattttgggtgccgtgccccttggcgaagatcatgtacgccgctccacctcatcgctgcgctctgcatcgtcgccggcacggataaacggataacctagatcaggatgcgttacgccacacccgtaaagcgtcgtcgacgaccccaacgcgatcgactgtacccacgtcgagccagtgcactcggtgatctcgatgaaaccacgaccgctgccgtcgcgcatagcgtcgatgacccaagtatgtctgctgacgcgcctcatccaaatggtcggcatcccctccagcgtcaagtgccgtgagcacttgagcgtatcccagcgcacgtgaggcagtgaccccgtcgcgcaggccccagcgtaacagcatgcgtacctcatctaccagaccttgcccgaacatcgagtcaatgcgccgcgccaatctctcactgagaatcgttctgtcacaatctaacccgacgatcacagtgtcccaccgaggagcaccgatgcgcggcgcggacgcggcgaagggctttccagtgagttcgaccacctcaagtgcccgcacagtgcgccggccatcggtaggcaggattgccgcagctgctgccaggtcacgacgggccagttccgcgtgcagcctaaccactccgacctcggcaagttgctgctcccacctcacgcgcacggccggatcggtccccggaaacgaccagtcgtcgagcagcgactggacatagagcatcgaaccacccaccacgaccggcaccgctccacgtgccgcgatcgcctcgatatcggcggcagcagtccgctgatagctggcaaccgtcgcagtctcggtgacgtccaggacgtcaagttgatggtgcgggatccctcgacgtgccgcgacgggcaacttcgctgtgccaatgtccataccgcgatagagctgcatcgcatcagcattgacgatctccacgctaacctggccgccaagtcgctcgatgacgtcgagggccagttccgacttgccaacacccgtcggaccgacaatcgcaagtggcctcatggctgccagacaccaacgaaatatcccacaccgtagggtgctccccggtataactccttcgccaatctaggccctggctcgaccaaaccggccaacacctggaatgccactcgccccgagatctgacaagacagccgggtcaaagccgcgacgtcgccgcttgccagggcgtcatcgaggactagctcggcatcggcggcactagggtcatagccaccgggggaactcgacgtcaaggtggtagcgccgtcagcgacgaccaatactccgatcggatcgggtgcctgctcaatctcgacgcgcaattgcctgccgcaggccaacgccatgtcgggatcgtggtcaccacaatacacccgcacctgcgcactggcgtccagctgggactggccccgcacccaggcggcgatcagtgcacacaccgggaagtcaaccagcagctcagcctcgccaccgacctgcggtgacagccgaacccgcacgtcggcaccaaagcccgcgaaagtgcccaggcagcccccgggacccacgacgtcgtctgcgcgacccgttccgacaacaatccaacacgggggcaagcaggcggccaccgccagcaccgcggaccttaggtcggccacttcggcagctgccgctccagtgagctcgggaacaagtaccggggcggacggaacgatcgcgatagcgctcagcacaccaccaaactaacgtctcagcgatgcaatgcatcgacgccgttggtactgcggtttcgaacgcaacaaacgaggcagactgatctgctgtgcaccaaacggggtcttagcccaaaccgaaactcgagtgcgccacgcaggtcggtgactttaacccttcgtcccccaaggtcaccctccccccgacgtttttctggagagtttcttccccatcttacttcgatatggattcgacctagccatgggccaacgacacggtcgcgatgatcaccagcaaaactcccgcaacaagcacagacgtcgagtgtcgagcgtctcaccgagcacgacaatgcccagcatcgatcccaaccaacgattgaaccacgaccgctgtcggcaacgatgcggtcagcaaaccggcccagaatgacgacggtgaaaaatcatccctgccagcgacgacggccagcagcaccacccaggtccactcacagcgaattatcgggcatcgggtcagacgggcgcagatcagcaacgcaaacagcagtacggtcaactgcagcgcccgtcaccagcatcaccaaccccagcgctagtgttgctgcctgcaacgcttaattgccgatcgccctgctacctaccggccttcgcgcactgacaagcggaacagctcaaggtgaccaatctgtttgtcggtaatctcctatgcggactgctgacggaccacatcaccgatgtccgataccagagcgagcaacgccggtatttcccctttgctacagggctccttccccgtccgaccccagaacatcgaaaaatccgagtaacacgacattttccgacacagtaccgtattcagcgaagtcgtcgtaccaaccgtgagacagtcggaatcgatttgctagtcacccagtcaggccatgatgagtcagcgtccgatcgggctcctaggagacggcgagctggccggcggccccattccgctggtttccggcctcgattatgacggcttcgtcgcaggccagggttacagtcacgacaaccaccgcaaccggctagcacggacaccaccacccgatgggtgtagcagagcctcacccagcacagtgcccccagcacctaagcaataacccggcctgaccaacgttattgtcggtaaggaggtggtcagcacgcacacaacggcgactgttgaaatatcaggcgatcggcaagaccaagagccaagtatacaactcgggggtaacgcatcagggtcaagcaacccttgctgaactccgtcaccactgctttggttcaacaccgtgaacacgaccagccaggccactgctgccagcagaacagcaccgcggataccgcacccgagcagacccgggctcccactacgcacagtaacaacaacgccgaaacgatcgccatagcaaccccggcccacatcgacaagagagcacatacccgaccaatcagcaggatacctgccatgacgattaaacccgctaccgactcgacgaaacaccgcccacagctactcttaggcggtcaaacgatgatgattcagccacaccaccgatcggtagtgtgaacagcaataccgtggcttgcaacgactgcaactaacaccaccgaatccaacgcccgggctgcagcctgcaggctaaaactaaaaaggatcactgcactgcccaaccaccactagactaggcgtagcgcagcaagagtatggagcagcaagagatggaatgaatagcgtgaggtggccgacctcctcgtcggtgacctgctgcgcggactactggcaggatcacataacccgacaccgatgaccagcgcgacagccaaggcgagccacgctgcaatgtggaagttggctatgggcgacctcccactgacatccatcccgaaaccgccagataacgcttcggttaagcaacggtccaataatgactcctgcgcgctagataagggacacaacgagactttcccttcaaattagattgctttgccaccggcgtagggatttacggaccgcaaaccgctgattgccgtggcggcgaccattagcgtacccaacccattcctgctttcctggcccttggtaaggccccctgtaacataaataatcccggctagtgcagctgctcgtctcggccggatgcaccacgtaacgcaaaacgggatccgacagctgcgggtcagtcacgtttagccactgcaggcaccggttgaggccgcggtgccggccgctaaaatcaatctgaaaaaatttgctcgacaacacatgaatatcttaatggacgacatctggtcgcgccaagaaaatcggacaggtcaactccttggatcaccgcattgccgttaaccgagcatagttttcacttgccatagctaacgagacggtttcgggtatgaaatttttcgtgcgcccagattgatgtaaaattaccattatgttactagaccagaatattgcggtagataggtcggccggcaagggtgctttattagtgcgatttgcctgttggttaagtaggcagcaatgaacgccaccgtgcgtggttcgcgaatgggggcctaatctgagccctcttacactcaagcggcaactgagtcaagacggcatagcgagggccatcaacaccgtacgacagtaggtggtggagctatagctgatgtcgaaagcgctctagctacgaaccagtatttcgcatgcgcatgcaacacgaaagccccgcaaaaccggtagattgcaggaaccgcatgtggtgtccatccataactacggcacaatcaaccggacagctgtacccggacatgcgcctggtcgaaagaactgccagggttttatggcgataagaaccgtgccatgccggcgccccgtccagagcgatctacacagtgttcggggcgacctaaaatatcgcgccacttcttcgacgggatcctgcgcaccgaacatcgtggtggactgtctcggagaacctaggtcaccaaccagttggcactgccccagtaaccccacaactaggcggcatggtcttttgcgtagtctaagacagcaacccggcgctggtatagatcaacggcggacgaactgatgatcggtcttgtccaagaagatccagcaggacccaacctcgaccaactctacggctgatggaaaagccttagctatccgccactcgaacccttcgcgaagccgccgccccaggaagccagaccaacaccgaaaaatggtgacagcgtacagtccgccaagctgcttaaataatgttaggaacggtattgggggtcggggatgacagctaccaagccacaccaagggtccccgaccgtgcaagatgccgctacacgcggcagagcgcgagacaacgatcgcgcaaagagtggcaaagggtaggtaaccaacacataacggccgacgcatcccggaccaacgattcgcccaagccgatgccacgtcccggtccccggcctatgccgcgacccaccacccacccgatggcaaggttcccgcccaacgacccacaccgattcggacgcgtggataacgacggcacagtgtggctgatcaagcgcggctggtgaacgcataatcggctcctggcaagccggtgaccgcgaagccgcatttgcccatttcggccgccgattcgacgatgtgagcaccgaaatcacgctgatggaggaacggctagcatcggggaccagcgatgcccgcaagatcaaggccaatgcagcagcgctggccgagacgttgccaacggcatgcttattgggtgacgtcgacgagctcgcgacccgattggcgaacctgctggcacgcgtcgacgttatcgtcgtcgcagatcactctcgacgcgacgagcgtcgtgccacgcagaccgcgcgcaaggaggcactggctgacgaggccgaagatctggccgccatactcaacccactggaaagtcgccggcaaccggctacgcacgatcctcgaagaatggaagacaatcagcggcctggaccgaaaggtcaacgacgcgttgtggaagcgctattcggcggcccgagaaaccttcaagcggcgacggggatcacatttctccgagttcgactgggagcgtactggcatcaagcaatccaaggaacggctctgctaacgggccgaaaagctgtccaactccaccgaatgggccaccacaagttcggaattccgaaagctgctcgccgaatggaagactgttggaaaaacaacccgggaaatcgacgatgccctgtggcgccgcttcaaagcggcccaggattactttattcgcggctcgcaatgccgcgtcagcgaaaaaagacgccgagttgcaggccaatgccatcgctaaagagacgttgctggctgaagcagaaaaactcgacactgccaaccacgaagccgcgagaacagcgctgcactcgatcatcatcatcaaaaaatggaacgcgatcgaccgggtcctcccggtaacagtccgctaagttggagcaaaggctgcgcgccatcgagaaaaaagtgcgcaacgccggtgaatcgggttggtccgatctccaggcgcaggaccgcgccgaacaattccaaacccgggccgagcagttcgaacggcaagcccgcaaggcattagcggccggccggatccaagaagcctaagaggccaaggccgaacaatggcggcagtggactgaagtcgaagctgacgcgtttacacacagaacctagctaccgacttgaggatccgatcgtgtcctggtgtctcggttgccggcgctgtacaagccatccagcagtgtctttgactgctgctgcgcaacgacccggcgccgttgctcctcggtagcgagttgcacgattgtgctcgaccacaccacgcgggcccagtgaaacgtcaacaagatcaacgtgatccacgccacgatgagccccactccaggacccggctgacccacagccacggtctggcgcgaccacacagctagcagcccaactatgctggccatcgccgcacccgccagcgcaatccaggctagcacccaacgccgtgtcatcaacgccagcatcgagaaaccgacaccgaataccagcgacagccaagcgaatatccgcaaaggcaatgccaccgcagccgctccggcgccgtggctgtcgaacaacacatcccagccccgcacctgaccggtgtgcggcaagatgaacgatcccagcagcatgaacaccaggaccgctattaagacgaaaatctttgctccagaatcaatctcacggactacccgaagttcctctgcctcaagtgcagcctggaggggattggaatccgggaagtccacgatattgggttcttcgttcatcgggcacatccagcagacccaatcgaagccgaatgctgaccgacactcggcatacccaaaggaatttggccaagcccaatgctgcgtgggcactgcctggcggcgtgtgcatccccagcacgggtgcggcggtgagttaatatacccgcatcggctatcagatggtgcggcgctgcttcagtgaccatcacggtgatgatatcaccgggccgcacctgcgcctcccagggcgtgtccaaggcgaaatgcaccaaccggccatcgcgtgcgcgcccagtcctgcgcgcggtgcgggcatctttgcgtccttcgccagtggtgactagcagttcgacaatccgcccaatcagcacacgattttcctccatacaaatctgctcctgcaactcaactagccgttcgtagcgttcctgcacaacggccttcggcagctgcccaccaagttcagcggccggggttccggggcgcttagagtactggaaggtgaacgccgccgtaaaccggacctgacgcaccacatcaagcgtggccgcaaagtcctcttcggtctcaccgggaaatcccacaatgagatctgtggtgatggcggcgtgtggcatggccgcccgaacctggccgataatgccaagataacgctcgacgcggtaagaccgccgcatcgcacgtagcacccggtcagacccggactgcagcggcatgtgcaaggagggacacacgttgggcgtctgcgccattgcctcgatgacatcgtaagtgaattcggcaggatgcggagaggtgaaccgtacgcgttcgagtccatcgatactcccgcaggaccgcagcaattcggcgaaggaaccacgattgcgggcaagcgccgggtcagcgaaagagaccccgtaagcattgacgttctgccccaacaaagttacttctagcacgccgtcagcaaccagtgcttccacctcagccaagatgtcagcaggactgcgatcgacctccttacctcgtagcgacggaacaatacagaaggtacagctgttgttgcatccaactgagatagaaacccaagcagcataatcggattcgcgggcactcggcaatgatgacggaaaatgttggagcgcttcaacaatttccacctgagcgaccttattgtggcgagcccggtcaaggagcgtaggcagcgatcccaggttgtgagtgccgaaaacgatatcgacccacggcgccttgctcagcaccgtgtgtttgtctttctgagccaggcagccacctaccgcaatttgcatgtcgggattgttccgcttgcgtggcgccaggtggctgaggttaccgtagagcctgttatcagcgttctcacgaacagcgcaggtgttgaaaaccaccacatcggcgtctccaacatctgcttcgtcagccgcccgctggtaaccggcggcctcaagcagacccgccaaccgctcagaatcatgaacgttcatctgacagccgtaggtgcggacctgataagtgcgtgtcgatccagtcgcagcatcatccgccatgcctgcgtcacgcgtcaccaccgaagtcacggggcaatagtacggcgaccgggtcccaccgagttaacccgcagcttaattagacccggcgccgctctcgttcggctgcaagctcggcgacaaccacctcgcatatggtggtctggctgtatccacggcgggctagcatagccatcagtcggcgactcacccgtgcgtcgtcctcgctaagtacctctcgccgcagtctggtacgcaccagctgctcagctcgctcccgctcgacggcggggtcgatcccagccagcaccgtggtaatcacctcactgtcgatccccttggcacgcaggtcagcagccaatgcacgcttgctctttcccacgttcgcccgccgagaccgcacccactgttcagcaaagtcattgtcatccaacagaccaacagcggccagccgatccaatacccgctcgctgacgtgatcggcgtatccgcgtttcgccagctggccgaatagctgggctcgcgttcgcgatctcgcggtgagcaggcgcaggcacaatatccgtgcctgctcttcgcgatcagaaatcgacgggggtgggcaggatgtcgtcatcggtcacgaccgcgccaatgccaagcttctccttgatcttcttctcgatctcattggccacatcggcgttctccagcaagaaattgcgcgcattctccttgccctggccaagctgttcgccctcataagtgaaccaggatccagacttgcggacaaagccttgttccacacccatatcgatcagtgaaccctccctgctaatgcccttgccgtacaggatgtcgaactcggcctgcttgaaaggtggcgacaccttatttttgacgattttgacccgggtccggttgccgaccgcatcgacaccgtccttaagtgtctcaatccgacgcacgtccatgcgcaccgacgcatagaatttcaacgcctttccacccgtcgtggtttcgggagaattgtgtaccatcactccgtcaacgaagtagttgtgattgccctcaacctcgatatcgaaccggttcattgatcgggtagacagtttgacatgaacatcgagaacgcgggccggcaccaactgctgcgtgggttcgacgaactgcggtgtcacgctcccccgaccacggaactgcggcaacaacttgtactccatggacggcgccacatatggagcgatcaatgactggaacttcgcagtggccgcagtggaaaacaccagcaccgccttaccggccgaaccaacttctcgcaaacgcacatccaagccgtgtgtgtcgcacagatagtcgcgcaaacgtacacgtgtgccttcggtcatggcatctacacagatctcaatgcgcccgctgccaccggcggtacgttcctgcaccctcttggaacccactgtgaatgaaccatcgtccatataccaaatagccagaaccaacggcgtcagcgccttgagatactcttcagataagaacttcttaccgtctccgaggtagaccgcgcgctgtagctcgacgagctctggcaatggggtgaagtcgataaaactcgcgcccatggaattctcccgcaccgtatgccgaatgttgcccattagcgccttcttccactgcagatattccacctgcttgcagccgtatcccaacaaccggaaccggacaccgttacgatcgcacagattgggcgagaggttcccgtcacccatcagtgagcccaacacaacttggaactgctgatcgctcagcatatgtggttcgacggcaagcacccgatcaccggcaataaggttaccggcttctgtccagccgccaggtgtgcgaatgaggtggttgggcgtcgccgcaaactgtgacttgccgttactaccggacttttcgacagtaaattggaggaactgttcagctggaccattattgaaccagttcactaccttgcgtggcacaatccggtccgtcaccgggtcgtaggacaacaccctgacatccattttgttgttgacgatcttgccgatcttttcagtggaaccgtccgcaagagtcacgcgggtcgagtaattcatgcacccgaacatcaccccaatcttctcacgtagctggttgatgaagatcgccgtggttcccgaattactcagcgcaccagtcattttcctcagtgcctgactcatcagccgggcttgcaatccgacatagctgtcccccatctcaccttctagttccgcgcgcggcaccagcgcagcaaccgagtcgatgaccacaatgtcgagcgcgccagaacggatcagcatgtcggcgatctcgagggcttgttcaccggtatcaggttgacttaccagcaaggaatcggtatcaaccccgagcttcttagcatactccggttccagcgcgtgctcggcgtcgatgaacgctgcgacaccgccgaccgcctgggcattggccacagcgtgtagtgcaacagtagttttgcccgaggactccggaccgtagatttccacaatccggccacgcggcagaccgccaatacccagagccacgtccagtgcgatggagccggtcggaatgaccgagattggctgacacatctcgtcaccgagacgcatcaccgaacctttgccatagtttttctcgatctgggccatcgccagctcgagagctttctcacggtcggggacttgtgccatgttacttctcctgtagtcggtaaccggtaccggtcggttggacgtgacactagagagccaccgacaagccgacatcgctgaataaccaccacaatatccgaacatctgttcgattcaagtctcgacacgccgtcccagcaatccgcgaaatcaccactgatcgcggggcacgtcgaagtcgacgcacaatgcccgccagacatcgcggagctcgacaccgtcttcaatcgcctgggcgacggtacgaccgtcgaagccagtcagcacgtgatcaaccaacacggaggcaccgtatgcagcaccgaatcgcagtacgactcgctcgtggaattccgtcaaccgcacgccagccaacttacccaatcagttacccggcgagccccagcgcttcgtggcacacctgaaccggatctgcaaccccagcgatactgatggcggctcgttgtgcagcctcgcgataatccggcgacgacagcaccttattaaccgcagctaacagcgccgcagcggtcaacggccgaatcaattgcgcactgccctgccgtaccactcgattggccatctcccattgatccccgccaccaggaaccaccaccaacggcaccccggccaacagcgttttggcaaccatcccgtgaccgccaccgcaaataaccacgtcggcatgcgccaacagcttcgtctggtgtaccaacccagccaccgcccaggacggcaccgtcagatcgggaccgttcagccgagacaccaccacgcgcgaccccgatggcaacgtgtcaccgggcaccagagcgtccaaagcggtctgcgccatgcccgaaatcccagtcaacgccgtagacggtgccacgactatcaccggcccggagccggaagggatctgcaacacccgatcagtcggctcaaagtgcaacggacccaccaccacggcctcagccggccagtctggacgagagacctccagcgcgggcagcgtagcgatcagccgtcgcagcggcccggagtcgcaagccggcaatccaatctgcacccggaccgctgcccgctctcgcaggccagcacgccaagaccgtgcggtaagcgcccgcatggtggcatctcgcatccggccgtgaatgccgacaccggacgccagtccgctgcctataggcggcaaacccttggacggcagatacaacggatgcgggttgagttcaatccacgggatccccagcagctcagctgccataccaccggccgcggttatgacgtcagatactatcagatcaggagccaagtcgcgcagcactggcacattaagcacagccatctgcgcagcacgccgatggatcctagccccggcatcgacatcgtcatcaacggccacgagcccgtccagcagggcagtctcgacaccggcggcccgcgcgatatcgacgcactccactccggtgaacaaagtgggcgtgtcccccgcttcagcgaaacgctgacacagagcgatcgcgggaaaggagtgcccgggatctggcccggcgaccacagcaacgcgcatgtagtgtaccatgccatagcaccgttatgtcatgtttcccctaagctggtagccatagctgagctgaccgaggcatctgtccaaggtgttgaaaacattcgcacggtcgaggttttcttggctgccctgcaggacgcaggattacgaaaccgcatacgcgacgttggacgacaacctcgtgtttaccagaacgtcggactgccaacaatccatggccgtagcaaaacgatcacactgtggcgtaagatggcagactgtatcgggtttgagataaagatccaccgaattgccgccgtggctatagccgtgctctgcgaacgcgccgacgcggtgatcgtcggcccactttggatgcaattctgggtctgtggcaccttcgaagtgcaaaataagcgaatcatgttgtggcggaattattttgatttgttcgatctgttcaaggcaaccatgcgaagcctggtcgcgctgagaatcccgtcgttaaacgcagcgttctaacaatgaaagacaaacacacccgcacgaaacccaacgcgctgtaatatgttcactataactgttatgggaattgctcgactcgatgcgagactgggtaggcaacgattcggccaggcaagggcgccgtcatctaaatgatggtccgcgtcgcgattctggctgtgctggtattcataccgttctagttgcccccaacgacactcaacgtttacttaagcatgacgttgccgatcctcatcccgttcgtttacttcccgcatgcactcaatgcactcaagcaaaatatggtgacgtcacatgctgggcgtgcaacaacctggaccccgaatgcgtcaaccaacttaagcgcaagtgcgacgcccatatccaccagacatacatcgagcgctacggcccgggccccaaggactaaccctgtctaacgcagcgacattccgccgagttcgtcgaacacctgcgcacaaacggccagagaatcagcagcggtggccagctcttcacgggaaaaccgctgcgaacccggcgcgaccctaccccggaaaccaccgacacggttcgtcgaagaaataaacctcgctacgatagtgacgatttcgttttacttaaggacaccggcgctcaactatgtagtgaacgcaataataattatcaatagtaatcattactttattggagaccagagaaaacaagatgattcaaaatagcacaccacccgctctatcgacaccaactgggcagcagtgacctccatcgccaccaagatttggttagccgcggcggtcaaatcacggatttcggctgcagggaacatttcgccctgccccatcaaacccaacaacgaaaagaacccgagttcggaaacgcccagctccgacatcgaaggtggggcagcctaaccgggtggcagtaatcgacgaactccgttgggccgccatgtcggcagcggctccgaccgcagccagcggtagcgaagcagcagcaacgtagcaggaatggcctgcaaaaccgcgatggagccggtgatctgcagcagcaacgtgaaccaaccccaggccgctagtaacgccgtcaccacgccccaaaacaggcacccgaaaccaaaaatcaagccccaccgcagcgcgcggcggcgacggcgaagcaggcgggcacgcggatccaacacaacgctaatctttttggcgagcaagtcggacaaatcggtgatggtgtccagtccacgccgcatcaacgcgcgccactgcccacgttggcttacattcacggccacctcagcaccattctcaaaccgcccgcgttgcttactgaccgagggatttctcaacaacgtgcacgtcgctagcttggttggtcgcgatactggccggtgtgcctccgggaaacgcagccgtaccgcccgtcgacaaagcttgactgagcatcgacgcgcggatctgctctagccgcaaatgaccggccatctgcacaccggcctgttcgatctcgatcatgcgaccctgcacggaaccttgtgccaactcggccgcaccgagcgcgttgacgtaccgacgttcaatcttttcccgcacctcgtcgagcgtcggggtatcgccgggcaccgcgatctcactcatcgaccgcagcgaagcactaacctgctcctgcatcttcgcctgctcgagttggctcagcagtttggtgcgctccgcgattttttgctgcagccaccatcgcgttctgttcgacagcctttttggcttgagccgccgcacgaagcgcctggtcgtgcaacgtcttgaggtcctcgacgctctgttcggcggtcaccaactgggccgcgaacacctcggcgccgttattgtactcggcagccttagaaacgtccccggtggcagtggcctggtccactaacgtcagcgcctggcgcaggtttagctggagcttttcgatgtccgccagctgcctgttgagccgcatctctagttgccgctggttgccgatcacctgcgcggcctgttgggtcagctcctggtgagtgcgctgtgcttcctcaatggcctgctgaatctgcaccttggggtctgcattctcgtcgagcttggcattgaacagcgccacgatgtacttccacgctttcacgaacggattgaccatgacttagctccgtcttcgttgcttgtgtagccggatggaccctgcgctttctctaacgctcaatttatcgggtaagcgcagatctccacacccttttggcaactcctatccgaggggcccggcacgttggccgcatttacgccactgcaacgaccccaccggggagaattgacgaccttggtgctgaccggtcgatgatgaagccgcttggcacgctatctagtacggtccaggctgcacgttacgtatgcgccactcgttcaccgacgtcgataagcaactctgacagcagccacctacaacgcgtcgcaaatcgtgttgagcaacttgctggaaggcgccttccagccgggctcaacctccgaatagataaccgagactcacgcacgcggaatccaacatctcacgcagcgtgcggccctgatccggcacaacacgttgcccatgacttcacgcactaaatgacaccatcgcgctccacctcatccggtcagtcactagatgaacgcagatggcctgctatggctcccgtgatcagctggctgtctggtgcactcccctgacggccctgattgtcccagccacgtagtcgacacccgtgaccaccgtaagcacgaccgcaactgccatcaccactgctgcacccacgtggaacggcactgacagttgcgtcaaaggcagcaggaacagaccgatcgctactgcctggaccacagtcttgagtttgccaccccaacttgccggaatgaccccgcgatgaataacagccaaccgcaataaagtcactccaagctcgcgagtcatgataagcaccgtgacccaccatggcaggtcaccaagcatcgaaagtccgatcagcgccgccccgatcagggtcttgtccgcgatcggatcgacgaacgcaccgaattcagtcgccatgccgtagcggcgggccagcaaaccgtctaaccgatcggtaatgcaggcaactgtgaagatcacgaaagccgctatccgaccgacgatttcgtggccattcccagcgaacaaggcaaccaaaaaaacggggaccaacatcagccgcaagccagtcaggatattggcgaggttggcaatacggacgcaatctaccatcggacccgttggaggctgccccgacacggcaaatagaataacggttgaccagctcgtgcgtccctgatgtcgatactgttagccgtgaccaaaaattcacagaattatctgccggtggtccggcgcgcacgaacctccgatatcccggcgatcaaacaactcgtcgacacctacgcgggaaagatcctgctggaaaagaacctcgtgacactctatgaagccgtgcaggaattctgggtggccgaacaccccgacataccgggcaaagtagtcggctgcggtgcgctgcacgtgctgtggtccgacctcggcgaaatccgcaccgtcgccgtcgaccccgccatgaccggccacggtgtcggcg

SEQ ID NO: 125 - DNA (genomic), 40429 bp, MYCOBACTERIUM LEPRAE; double-stranded, circular
  hypothetical: NO
  anti-sense: NO
tggttactaccgctgtagaagggcagccgtccgacattgagttcgatgatgcgcagcatccggtacaattcaccgaatggattctttgagcatgctgatattgtcgatggactcgaacatgctgaccagtaattcagtgctcatatcgatgccgctgctgtccggattactataggccataataggaaaaagggcaagatcaccacctaccaggctcacgatcgcatctagcggctattggctacgtgccgagtagaaaggtcccgtcaagaaccagacgcggctgccaccgttttatgataccaccacctgaccgtccaccgcgatctcacgatacaattgaacattgatccgcagcccacccgctgaacggtaacaatcgtccactagttcggattgccacattgcgatatagcccagtggctgaacaccggagatctggggtggacacagtgttcagatatttcgctgagtcagcgttaaagaccgcttaactgggcggatcggtgttcatgtagtggatattgacgatcagatcactggtgattattttgttagtatagaccagctgggtctgcgggtgccgtcggtgtagtcgttgcgacttccggcaccaccccaaacgttgtgatcgcgaccgcgctgatcatttttcgcaggttcatcatgacaaaaacacttaccggattcagttacccgcgtagcagtcccggcagacgttcaccggccagatacatcagcggtcgcccagctcggggtatgaagcatgaataagcgagatccgcaacgggacgatggtcctgacccgaccacccgaacatcagaaccgccgtcagccgccgcaggttaacggcgagtacggtagcggcgatcattggtgcgggcagagctgcactgttgtgatctcacccacgcggtcacggatacataccccggtcggaccgacatagcgcaccgccggtgggtggtctgcatctgcaatttggcaaaaacgccgcaaccgaggttatcgtgtcatggcacaccaccgacgccatccgcagaccgcgagtcatgttcgacacgccgacatctgggctcggtaaaaccgtgccaacataaacccgaacataccgagacgcacagtccacacccaggtccgcaccaaccacacccacttgacgaacctgaccgcggacaccgactacatctacgccgcggtccatcataggtatggagcccgggctaaggaccgtgcacaccgcaccagaatgacgaaaaatggctgctattaatacagtttcagtggtcgatctactccggagttaagccagttgaccaataatacatagcattaatcaacaacattggctcgcccacagccgacgataccacgatcgcgatcaaacgcatcgccctgctgttcaacctcgtgcacggtgacctatgctaggctgaactcgcctaagaccggacccgcacttggttgggccggcttgacaacaccacccgattcgacgcattaactgtcgttgatgccggccttcggcaatcacgagagcgaattaggcaatgggccaattagttacggttcctatgagatctactttgcggtgaacaatttgggatctagtcctcagctctatgctactcattcaccgctaactctgtgcgggtaatcagccggaacaacgaggacgtggccttacaagatggccgcaattcgtacgtgcataaatactaggtaggaaagcaaaagcgctaacttgcagacaaattagccgacgcacgaaacgacccagattttgactgggtggtcgtttgtattcatcaggcgacaatctccaccactgaccgcaacaatggcgtcgacatcgggatttcgcgaggaatggttgaggttgttcgacgagcaccaggtcgatctcgtgatgcgcagccacgaacaccattaccgaacgctcacacccattgcgcgtaatattgggtgcagacacccgaaacaccaattcccgtcgacctcatcgacgccacccagggcacagtgcacatggttatcggcggcggtaccccgcgcccagcaacgcgctgctgttccctccaaccttagtgcccttagtgccgcgtggcttaccgacgtcggtacatttgatcccgctatcggacgtaaggtgccgatatacattttatacagatgcggcgcggtcggtgtttcacgaccgcaacaatccttacggctttctacgtcaatccgggtcaaccagtccacaatatgatgtcaatcaaggcaacgtattacgcggtgagcgggctgttcaacgccatcaccgcaatagaccagttcgctactggcgtgccggtggtgctgtgtgacccggaaccgccgccgatatggtcgtcaatgccaccggcggtgatcacccatcagctgatacctcgtaatcagcagcgcagcacgttgccgaaacatctcacggtagctcagcggcagataggctctacactggtagaattcctggtacgggccgacgaattcagaatgcgcacaggccaaccaggatatgaatcagccgcgggtcgaaccacgcaaatgtaggacgaaaaccttcacaccggcagccacgttcccgtccaagcaaccggtcaaggtgctcgatggagtcggtgagatacggccaaaccaacaaccatcacatgccagtccagaccggcgtaacggattgcgctgatcagccccagaagctcctgcggtatccgatgtgcccagttcgacatctcagtgtaactctgcatcagctaccgccagcgacgccgacacctgttgcacctcgtcggcgatgagcgacaggtccctacccagcagggttccgtagggcgaaagattgacagcagcgtgccggaccccgacgagcgtgttgatgatgccgggcatcaatacgtagcggctctcgaaatgcggaacgcgcacgcttatggacgaaaccgacccgctgcagccgccagcagcaccccgtcgtcgacaaacgtcccgttgactacgaagtttgaccagcccaacacatgtttatatgcgaacatcaatcccaatattcgtcaagtccacacgcggaagggctgcaccgcacccatcatccccgaagtgcccgccaattgaccaccgttgcctttcataccgccattgccaatcagcggatgtcccagcaacgtctcggtggacgcattgaccaaacccaacagctcctgctccaaagtctgcaatagcgaggcatttaccgacctagcactgacataacgcgtcgcagtgacattgagcgcctgcacgaacctgttaatgaaattgctccacctgatcactgagcgcccggtaggccagaccgtacccggaaacaacgtcgtagtggccgccgaatttcgtcatcaccggccgccagtactccagttgtttgcgcggcagccgcggcgtcgacttcgctcagcgaagtgccgattccctacagatccgtcgctgtggctgccaccagttcagggagcacaataacaaacgccatgtcttcgctcccaacacctcagcatccccgcgagccggcttctgcgatcacgtcaataaccgtatggtcaataacgccgacccctggttcagacgaacgacaaatttcgtctgacgaagtcagccgagctaactcggagctattctcgaaattacttcggcgacaacagaatctacagctaccgaaatctgttcaccggtggctagatccctcacaccgacaccgtcggccttaatggcgcaatcatctactatcaacgcgatgcgagcaccggaacggcccgccgcacgcatcgctcccctgatcccgcgatccccgtagatcaggtcgacgcggacgccggcagcacgcagttgcccggccaacatcgccaccttgagtttagcagcttcacccagcgacacaccgaatacgtcgcagcgtgtggtttcccccacggtcttgccttcggcatgtagggccagcaaggtccggtccaccccgagtccgaatccgatgcccgacaagtcctgcccgccgagctgacgcattagaccatcataacgtccaccgccgccgatgccggattgcgcacctaagccggggtggacgaactcgaaggttgtttttgtgtagtaatccagccctcgcaccatccgcgggttgatgacatatggcacccgcagagcgtccaggtgagccagcaccgtatcgaagtgctgcttggcgccatcggacaaatggtctagcaacaccggagctgcggctgtcatcgcttgcacctggggtcgtttgtcatcaagcacccgcagcggattaagctcggcgcgtcggcgggtatcttcgtcaaggtcgagctgcaagagaaactcctgcaacagttttcgatattgcgggcgacaagtaccatcgcccagcgaagtgatttccaactggaacccgtccagacccagggagcggaagccagcgtcggcgatggtgatcacctcggcgtctagggccgggtcgtcgacaccgattgcttcaacgccgacctgctgcagttggcgacatcggccggcctggggacgctcgtatcggaaaaacgggcccgcgtagcacagcttcaccggcaacgctccacggtccagaccgtgttcaatcaccgcacgcaccaccccagcggtgccctcgggacgcagcgtaaccgagcgatcaccacggtcagcaaacgtatacatctccttggctaccacgtcagtggactcaccaacgccgcgagcgaacaacgcggtgtcctcgaaaacaggtaactcgatatcgccgtaaccgcgcctgcgggcggcagtgagcaaaccatcacgtaccgcgacaaattgcgccgagtccggaggaaaataatccggtatccccttgggcccagaaaacgaaaacacagtgcatgactccgtcacaagctacaggccctcgaggaacggattgaaacgacgctcggcaccgatggtggtggagttgccatgcccgggtagtaccacggtcttgtcgtcgagtaccaacaatttttcgacgatggaacggtataggtcacgaccactgccaccaaacagatcggtgcgaccgatggtgcgctcgaacagcgtgtcgccggtcaacaccacgtcggtatctgcggcgacccaaaaacacaccgagccgcgggtatgtccgggggtatggtcgacgttgacggtcacactgcccaaatcgagcttatcgccatcccggtccagctcgacgacctgcttgggctcacgaaagaacgctcccgtgacgacctgcgccacccgcggaccgaagccgaagagcggatcggtcaacatgaaccggtcctcgggatgaatgtacgtcggacaaccataggtgtcggacactttctgggccgaccacatgtgatcgatgtggccgtgggtgagcagcaccgccgatggagtcaaacgattctcgtcaaggatgcgccgcagcgggcccatcgcacgctggccggggtccactatgacggcatccgtacccgcccggtcggccagcacgtaacagttgcactgcagcatcccggcgggaaatccggtgattaacacacccccagtttcccatcccttagccgtcgacgacaatgcggtccactcagcagccgagacagacgccgcgaaacaaaaacttgacacaggtcgaggcgttcacattagccttggctggcaactcggccccaattaatcgaacaaccatggaggcataccggacgtgccgaccaacgaacagcgacgcgcaacagccaagcgcaaactgaaacgacagctggagcgccgcgctaagcaggcccgatggcgccgagtcctgttgataagcggtggcgtggtagtggcagtggccgtaattattacggtagtggctaccgtcgtgatcagcaagcttggccacaagcacgataccgcttcgtcgaccgccagtaactccctgacagcgactaagactcccgccgttacgccgtcagttctgccattgccatcattccaaccgtcgaccaacctgggcgtcaactgccagtacccaccatcagcggacaaggccgccaagccagtcaagccgccacgggccggcaaggtgccgaccgatccagccacagtgagcgcaagtatggctaccaaccagggcaatatcggtctattgctaaacaatgccgaatcaccttgcacggtaaatagtttcgccagtctaaccggccagggctttttcaacaacacaaaatgtcataggttgaccacttccctgatgctgggcgtcttacagtgtggcgacccgaaagtcgacggcaccggcggcccaggatacaagttcgctaacgagtaccccacagatcagtacccgcccaacgaccctaaattgaagcaacctgttctgtatccgcgtggcacactggcaatggccaatagcggtccgaacaccaatggcagccaattttttctagtctaccatgactcacagttaccgcctgagtacaccgtcttcggcacgatccaggctgacgggctggccacgctggacaagatagctaagggcggaatcgccagcggcggtgatgacgggccaccagccaccgaagttaccatcgagtcgctgcggctcgactaaagccgtccggtcatccacgtcaaagcagagggggatttgccgagtaaccacccgaacgtcaagacgcagacatcacccgatagacatcgtaaacgccttcgacattgcggaccacattgagcagatgtccgaggtgcttggggtcacccatctcgaaggtaaaccggctgatcgccacccggtcacccgacgtggtgaccgacgccgatagaatgtccaccctttcgtcggctaacgcgcgtgttatgtccaacagcagccgatgccggtcgagcgcctccacctgaatcgccaccagaaacaccgacgacgacgacggcgcccacaacacctcgatgatgcgctcggcctgctgctgcagcgatgccgtgttggtgcagtcggtgcggtgcacactaaccccgccgccgcgggtaacgaaccccatgatcgcatcgccaggtaccggcgtgcagcatttggctagcttagtcagcacacctggggcgccggggaccgaaaccccgacatcatcggtgctgcgttgacggcgcagcatggtcgtcggtgtggaccgttcggccagttcctcttcagcctgatcgataccgcccaactcggccaacagccgctgcacgacgtgccgggcagacacgtgtccttcaccaattgcggtatacagtgcggacacgtcaatgtaatgtagctcacgggccactgccgccatggactcaccattcaccaagcgctgcaaaggaagtccaccgcgacgtacctcgcgggccatcgcatccttaccagcctccagtgcttcctcacgccgctccttggcgaaccattgacggatcttcgtcttagcgcgcggcgacaccacgaactgctgccaatcccgcgaaggcccggcattgggagctttggatgtgaaaatctctacgaattccccgttttccagcttgcgctccagcgccaccagtcgtccgttgactctggcaccaatgcatcggtgcccgacctcggtgtgcaccgcataggcaaagtccaccggcgttgacccagtcggcaacgtgatgacgtcccctttaggagtgaacacaaaaatctcttgcactgcaaggtcgtaacgcaacgactccaagaactcacctggttcggcggcctctcgttgccagtcgagaagctgccgcatccaggccatatcgtcgatctctgcggctgcatgtggatgcagaacaccgttgcggcccttggcttctttatagcgccagtgcgctgctatgccgtattcggcggtacggtgcatatcgcgggtacgaatctgtacttccaaaggcttgccctcgggcccaacgaccgtggtgtgcaacgactggtacacaccatacctcggctgagcaatgtagtctttaaaccgtcccgccatcggctgccacaacgaatgcaccacgccgacagcggcatagcagtcgcggatctcgtcgcacaggatacggatgccgaccaagtcgtgaatatcgtcgaagtctcgccccttgacgatcattttctgataaatcgaccagtaatgcttgggccggccctccaccgtcgccttgattttcgacgcacccagggtacttatgatctcggcacggaccttggccaggtaggtatcgcgggacggtgcacggcccgctaccagccgtacgatctcctcgtattttttgggatgcaagatcgcgaaagacaggtcttccaactcccacttaacactggccatacctagcctatgcgctagtggtgcaatgacttccaatgtctcacgggccttgcgcgcctgcttttccggaggcaggaagcgcatggtgcgcatgttatgcaaccggtcggccaccttgataaccaacacccgtggatcacgggccattgcggtaatcatcttgcggatggtctcgccctcggcagcactgcccagcaccacccgatccagcttggtcaccccgtcgacgagatggcctacctcgtcgccaaattcttcggacagtgcctcgagcgtgtaaccggtgtcctcgaccgtgtcgtgcagtagcgcagccaccagggtagtgatatccatgcccaactcagccaaaatgttggcaacggccagcggatgggtgatgtacggatcaccggaacgccgcagttgactggcgtgccgttggtcggcgacttcaaaggctcgctgcactatcgaaaggtttgccttgggataaaactctttatgcacagccaccagcggctcgagcacgggactgatggtgctgcgttgagcggtcatccgacgggccaaccgagcccggacccgacgagacgcactgctagaagtcttcagggtttcgaccggcgtctccggtgcctcaacagcagggccggggaccacctgaactggttgcaaagcttgcgccgtaccttggtcgtccgccacgttggtcacctccgaccttaaggatatccctgagtccgattgacctgcttctcccaagccattccagcacggaggggaagtacccagatagcgaggctaggcgcggctcaaactttgtacctgcagcggtgcgatcgcctcgcgaccacccaacgccgtgagttccataacctaccgccgccgcaatggcaccggacccgctgcgctccaataatcggcacaccacaccgagagtgccggcagtcgccaagacgtcgtcaataatcaccacgttgcggctgcgtagctcgacgctgtcagcgggtacctcgatgatgccgctggccgttactccatgatgtaatcttcgctgagcacagacagcggcagcttgccgctcttgcgaatggccaatacaccgatgtcgagccgggccgctgtagctgcaaccaccatagtccctcgaaactcgaggccggtgaccagatcagcgccagctgcaacgtctgctaacgcatcgatcaccgctggccatcgcctgtcagtcagcgaacagcggagtaaggtccttgaactggatggctggcgtcgggaaatcggccgcattccgagtcaaggcagcgataaggtcggccacggagacacctcctcaaaccttaaagcttttcatcgtactaacgcccatcgatccatgttccaacccgcgccccaacgggtcggattcctggtaactgcatacattgtcttcgacatcagcagcattcgctgctgccggtatagaggcaatgtcggcatatccgcccagagtacaggtgcactatcggcgaggagccgaacacgctcggctgggtcagcggataccgccaacgcgccgatattgttgtcaacctgcgcgtttgcatagccagacaggttgttgccgttgccggtgtgtaggtcataggcatccatcgaagatgacccactcgatccgctgccggtggcgccaccagtgctggccaacagcacgtcgatctttccgtcccgaagcgcctgcgggcccgaggggtccgtcgaggagtccaaggtaacgctggacacactgataccagctacagcgcacgccttggcgatagtcccgacggtggccgccaaccgtgcgttgggcccttggtagccgatccgcaccggcaacgtctcaccactaagtgcgtcgtgcgctgcggcgggatccgccttgctgaactggccggcctcgcgagcaccgtcggccgcagcgatggcatcctcggtagccggggacaggcgtgagttggcgatcgacaaccccgcgtctcgagcgaccacgtcgcggggcgtacacagcgcgagtgcgcgcgggcggcagccgcagccagcagcccctgcggcgcaaagatcagctgctcgatgcccgccgacggcgagtcgatgcgcgcgtaattgtccggagtggccagcgatcccgacgacccgaccgcgacatcgacgacgtcgacgctgcggttgttgactcggtcctggatgtcggcttcctgtggccgtactgtgatccgcttggtggtcgccttgagaccccaccaacggtcgttggctacaagcactacagcgccaccgttcaagacggattcgatcttgtatgggcctgacgacgggaagcgtctcaaatcgacagctggtttgaggtcccaggtggtgttccacaatcgcgcgatctgttccaccaatgtcgcattgtgggtcagcaatgcctccgtcacgtcgatattcagttggtcagcgatgacgtgtgacggcatcatcgaggtcgcggcgaacagctgttcataatcgacaacgctgcggtccgggacgaagaacacgcgggatttcttctgcccggccaggcactcgatattagcaatgtcgcggtaaccggcctgggtggcagcatcgaagccgggaaaccgcccagactgggcagcccaggtcagcaccaaatcatcgcaagtcacctgcttgccgtcggagtagacagcattgtcggctatctggtagtcgagcactaatggcaccccgcccaccaccgtgatggttccgaagtcgtggtcagcgactatctgtccatcggggccgtgatagccgaagccgatgagcgtgcgggcaaacgcctgcgctccggccgacgcagcaccgacgatggtgttagtgttgtaggtacccaacgccccgtcgaccacatagacgatctcccccgcggcgcttccagaacacgcagtcagcgccaaagaagccaccagcgtcgcgaccaagcctactgcagtccaccgcaaaaccccgaataagccggaccgcaaatcgtactcactcacggcttgccaacctcgggtagccaccttgactaccgccgaccgacgttgtttcgcttgccggtaggacgtcgggtaccggtcggccgcaccggacgcactcccggtgccagcttgctgagtaccgtgggcacggacgcggtggcgacctcggtgccctcctgcgacgatgcgtcagcgcaggattccgcttgattctgcggttttcgggtgcctgctgcaacgtggctgtcagcgttttttttgcccacttgcgaaccgagggtgcgccgtttgactacccggcgggtgtgggtgcgtaccagctctgtgcgttcacgcagcgtgaccaacagtggagttgcaaagaagatcgacgagtaggtgccgacaatgatgccgaccagctgcactaatgccaggtccttgagcgtaccgacgcccagcaaccacaccgcgaccaccatcagcgccaacaccggtagtaccgagatcaggctggtgttgatcgaacgcatgaaggtctgattgatcgccaagttagcctgctcagcgaaggtgcgccgagtggtgtgctggaaaccgtgggtattctcctcaactttgtcgaacacgataacggtgtcgtagagagagaaaccgaggatcgtcaacaagccgatgacagtggccggagtgacttcgaagcccaccagcgagtacacgccggctgtgacggtcaggtcaaaacacatggtagtcagtgcggagatagccatataacgctcgtaccgcacagtgatgtacaggccgactagcaccagaaacaccacaagagcgatcaccaccttcttggtgatctgaccgccccaggtctccgataccgccgcgtcgctgattgcctgcttgctaggcttagcgtcggcgcctttgggtccgaatgcgtcaaacaaggcgttacgcagcttcgacgtctggtcattggacagcgttttcgaactgatccgcaccgttgctgacgcgccgttaccaacaacgaccaccgattccggatcactgccaagggtcttcttgaagacatcggcaacctgcgcaacctcaattgcgcctgtcccccccactccgggcgagacaggcatggacaccgtggtgccgcccttgaaatcaatcccgaaagtaaacccgcgaacgataatggacaggaccgcaaccgccacgatgacgccgcccacgctgtaccacagccgccggcgtcccaccacctcgaacacaccggtgccggtgtacagtcgagaaaggccggtgtagaaccgagcaagaagccgtgctgcggcagctgtgtggatatatcgttagtcagctccacggcatcctcggcggcttcggtgacttcgaccgcaccggcgccattgtcgtcggtgttgtcatttcggtctggttcgtcgatacccttggtggtctcggcgccgactttggctctggagaccatcgcgctacccccgtcctgtcttgcggaagcccgtcgttcgcgggcaacctgttgaacggcgcccaagccgttgtatgccggccttgccagcaacggagacttggaagccaagtacaccagcggccaggtcaccaggaacaccaccaccaggtccaggatcgtggtaaggccgagggtgaaagcaaatccctttacttggccaatcgccaggaagtgcagcacagcagccgccaggaaggtgacagcgttgccggacacgatcgtcttgcgggcacgcacccagccacgaggaacagccgaccggaacgaacggccttcgcggatctcatctttgatccgctcgaaaaacaccacgaaggagtcggcagtggtgccgataccgatgatcagacccgcgatacccgcaaggtccaaagtataattgatatatcgacccaagagcaccaagatcgcaaaaattattgtgccggaacagaaaagcgaaaacgcggtgagcaatccaagtacccggtaatatagcaacgagtacagcaacactaggctcaggccgatcgcacctgcgatcagacccgcccgtaacgatgtcaaccccaaagtcgccgaaactgtttgagcttccgacggctcgaaagatagcggcagcgatccgtatttcaaaacgttggccagctggcgcgcggttgcggcggtgaacggcggatctccaccactgatctgggtacgcccgcccaaaattgcctcgttgattaccgggacgctgaccacctcggagtccagggtgaaagcggtctgagtaccgatgtgggcggcggtgaagtcagcccagacatctgcggccgcagacttgaactgcagatcgacgacgtagccgaccccacgctggttcatgccggacgtggagttttggatctggtcgccgctgatgatcgatggcgctaacaaatacgccatattatggtcggtcgagcaggtcgccagaggcagattcgggtcgtcattgccggccagaatgtcgtctttgtcgcagtgggtggattcgaactgcaatgcgaggaactgaatactctgtttggtgctttgccgccacttcttctcctcggcaatgcgttcagctagatccttacgcggatccggtggcgcgggctgctcaaccgagggaacctcacccggtagtgccgctccggttggcactggacttggcatcggatctgagctaggtgatgacgtcggatcttgcaggtaggggcgtggttgcgcgcctgggtggtcgggcggcatcggcgcgaaattgggcaacgtgccggcaggggaacccggcttggggtcttgaccacgttgcacgggtagcgagttaagcaccggccggatgtacagacgcgcagtctggcccaggttgcgggcctcgttgccgtcgttgccgggcacagtgatgaccaggttgtcgccatcgacgaccacttccgaacccgatactccgagcccgttaacccgggagctgatgatctgctgcgcctgtgacaacgcctcccggcgggcgcgagccgtcgggcgtgcgcgcggtcaacgttacgcgggtgccgccttggaggtctatgccgagcctgggaacgacccgcttgtctccggtgagaaacgctaacagatagaccccgatgaataacaccagaaacatcgacaggtagcggccaaaatgcactggcgccgaagacgatgccacgttccttgtatctcctcgaaatcggtttttcccgacagagcctacgtgtcgcatcactaggcccttcacacaagacacaagcgccgtcaggaatccctcatcactcgttcctcgacgttagctggagccgtcggactcttctagctcatcgcagtacacgaaatcccccggttcggcctcgtgttcgtccatatacgcatcgtccgggagaatccgatcacgaatcgccagcttcatccaagtagttacgacgcctggcgcaatctcaagatcgacggtatcgtccccgacgacaatgatggtggcctgcaggccggaggtggtattcactcggtcgcctggctgtagcgagttgtacaggtcgatcgtggcttgcatcgagcgtctttgacgcgcgacgcgaaaaacatgaacccacccatgatgagcaggaacagtaagagtaaaaccaaactctccatcgacccatcaacccacctgtattttgtatgtattttttatttggtactgggcgcaacgctggccagctgaccggcggacgcgcaccaaaataaccgttcagtttgtgctcatctactctggcaggtcccaagtcgcacccaacccggcacagtgcgcacactgtcgcccagagacgtggcctagccacactcgcccggtgtgagaaccccgataaaggctatgctttatctgcgatacaaccggcgtgtcgtagtcaggaggatccacgtgaccagcgtcgagcagagccgtcagctggtcactgaaatccccggccccgtgtcacttgaactagccaaacgcctcaacgcggcggtgcctcgtggggtgggagtcaccctgccagtgtttgtaacgcgcgccgccggcggcgttatcgaggacgtcgacgggaaccggcttatcgacctgggttctggaatcgccgtcaccacaatcggcaactcgtcgcctcgcgttgtggacgcggtgcgcgcccaggtggccgactttacccacacctgtttcataatcacaccttacgaggagtacgtcgccgtcaccgagcaactcaatcgaattaccccaggatccggcgagaaacgctcggtgctgttcaattccggcgccgaggcagtggagaattctatcaaggtcgcacgttcgtacacccgcaagcccgcagtggtcgcgttcgaccacgcctaccacggtcgcaccaacctgacaatggcactgaccgccaagtccatgccgtacaaaagcggctttggtccttttgcgccggagatctaccgggcgccgctgtcctacccctatcgggacggcctgctcaacaaagacctagccaccgacggcaagttggccggcgcacgggccatcaacgtcattgagaagcaggttggcgccgatgacctggctgccgtgatcattgagccgatccagggcgaaggcggtttcatcgtcccggccgaagggtttttagctactttgctggattggtgccgcaagaacaacgtgatgttcatcgccgatgaggtgcaaacggggtttgcgcgtaccggcgccatgttcgcctgcgagcacgatggaatcgtgcccgacctgatctgcaccgccaagggcatcgccgacggattgccgctggcggcggtaaccggacgggctgagatcatgaacgccccgcacgtcagcggcctcggtggcactttcggcggcaacccggtcgcctgcgcggcggctttggcaaccatcacgaccatcgagaacgacggcctgatccagcgagcccaacagatcgaacggctgatcaccgaccggttgttgcgacttcaggacgccgacgatcggataggtgacgtacgtggccggggtgccatgatcgccgtcgaattggtaaaatccggcacggctgagcccgaccccgagctgaccgaaaaagtagccaccgcagcacacgctaccggcgtcatcatcttgacgtgtggcatgttcggcaacatcatccgactgctgccgcctctgaccataagcgacgaactgttggccgaaggccttgacatcctaagccggatcctgggtgacttctagactagaccaagaacccctgaagtggacgatctcacatctgtaacccagccactgaggaatattttagcacagctaattttctaattgtctgtgccgtgtggcgccaacagtctatttctcatcgcaaggaatctgttatgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgtcgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcagcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatagcggagaccccaaactgctggcgcactaccaggaactggcaaccgaccacctggaggtcatcgccggcgacaaaggcgaagtagatctggaattggaccggcaaacgtggcgacgactggccgacacggtcgatctgatcgtcgaccccgccgccctggtcaaccacgtgctgccgtacagcgagctattcggccccaatacgttaggcaccgccgagctgattcggatcgcgctgaccagtaagcaaaagccgtacatctatgtgtcgacaatcggcgtcggtaatcagattgagccagcaaaattcaccgaagactccgacatccgagtcattagcccgacgcgcaacatcaacaacaactatgccaacggctacggcaacagcaagtgggccggcgaagtgctgctgcgcgaagctcacgacctatgcggtctgccggtcacggtcttccgctgcgacatgatcttggccgacaccagctatgccggtcagctcaacgtccccgacatgtttactcgaatgatgctgagtctagccgccaccggcatcgcacccggctcgttctacgagctagacgccgagagcaatcggcaacgcgcccactacgacggtctgcccgtcgagttcatcgccgaagcgatctccaccctgggagaccaaagcctgcacgatcgagacgggttcacgacctatcatgtaatgaacccgcacgacgacggcatcggtatggacgagtttgtggactggttaattgatgccggctgccctatacaacgcatcaacgactacgacgaatggctgcgacggtttgagatttcgctgcgcgccctgcccgaaaggcagcgtcacagctcactgttgccgttgttgcacaactaccagaagccggagaagccattgcacgggtcgctggcacccacaatccggttccgtacggccgttcaaaacgcgaacattggtcaggacaaagatattccgcatatctcgccggcaatcatcgccaaatatgtcagcgatctgcagctgctcgggctggtttgaagacaggcgggtcgatcgccagcctgagtaccgttttggacgtttcagcctgcccaggttgaggcagccgagagactcttgtcaagggcactccgggtacttagtaccgtggcggcgaaggccaaggaggtagtggctcctaaacaccatcagcgcctagggcgacgccaagcagaccctttggttagcatcgagcaacaccgaagccagcggcggacactggcaaggacggctgctcggacttctctagacactagcgcgacgtcgatcacgaatgttattgctgatgcggccaacgcacataattggcatcagatgcgccggctgccgcgcccacacgctgtcgatgcggctacgcccgtggcgtagccgcatctggtgaactacgccacgagcgttgactcctacgcggccgagacgaacggcaccgaaaccacccgctgcggcaggtgctgcggagcaatgtagcggaccaaccgtacagtaagacgcgccaaaacgacgccagcaccagctgagtaccctgatgctgcaggatgcagcctgcacgcttgcgcccgaggatttcagcaaccggattgcaacaggtgtctctggtgttacgacagcaagccaagaaccagcagcacgaccgcggccaaaaccatagatccgacgccggcgaaaaggagggcagcccaacggcttcatgtcccagcgcagccccggcaatgccgatgccactcacaatagccagaaataacagaagtaagttttggaagcccttgggtgagcgcaagtagtgttatggtctcaggcttcgtacacagtcatgccgaacatggcttgggtgcgcgcagaagtccacgtcaacgattccatggtgaagacgtagacgtgcagtaccgccggcgagggcgacgcagatcaaaccggcggcaatcatcatcccgctcctcacgactcgaataaccccggctgactcaacccggtgaccccgaccggcggtgtcatgcacaggtacgtccaggcctgcgcagtagccacccggccgcgcggggtccgtgccaccatgccggcacgcaccagaaacggctcacacacctcttctacggtggtcgcctcctccccgaccgccaccgctaacgtcgaaaccccgaccggaccgccgccaaagctgcgagtcagcgccgacaataccgcccgatccagtcggtccaggcccagctcgtcgacgtcgtagaccgccagagccgccttagcgacatcgcgggtgatgacgccatcagcacggacctcggcgaagtcacggacccggcgcagcaaccggttagcgatccgcggcgtcccacgcgagcgtcgagcgatctccgcgcctgcctcgacgcccaactcgatgcccagaatcccagccgcgcgagccaacaccccctccaactcagtaggctcgtagaaatccatgtgtgcggtgaacccgaaccggtcacgtaacggtccggtcagcgcgccggaccgtgtggtagcgccgaccagagtaaagggtgcgacctctaagggaatcgatgtcgctccaggcccttttccgacgatcacgtcgacccgaaagtcttccatcgctaggtacagcatctcctccgcaggccgggcaatacggtggatttcgtcgatgaacaacacgtcgtgctcgaccaggttggatagcatcactgccaggtcacctgcgcgttccagcgcaggaccggacgtcatccgcaacgaggaaccgagttcagcagcgatgatcattgccagcgacgtcttacctaaccccggaggaccggacagcagaatgtgatccggtgtggcgccacgattcttggccccttcaatgaccagctggagctgttcacgcacccgcggctgaccgatgaactcccgcaatgagcgggccgcaggctgacatcgatgtcggcttcgccgacggtcagcgccggggaaacatcccgatccaagtagtcctcgctcatcgggtcttgcccagcaacgacagagcagcccgcaaggcgctggacgttgccaccgccccatcttttccaagttcaccgtcgagcacctggtcggtcgcttcctcggcctgcttggccgcaaaacccagccctaccagggcttcgaccacagaacctcgcaccgcgttgccgtcagcagcagtacccacagtcaatccagacgcccctaccgggccaaccttgtcgcgtaactccagcactatccgttcggcaccacgcttgccgataccgggcacccgggtcagcgaggcgacatcactatcggccagtgcctgccgaagcgccgcagcgtcgtgcacggccaatgtcgccatggcaaggcgaggcccaactcccgagactgacagcagcgctaggaataggtcacggttctcggcatcagaaaacccgtacaacgtcatcgagtcctcgcgcacgaccattgcggtgaccagtcgggcctggctgccctgccgcaacgtcgccaacgccgacggcgtcgcgtttacccgatagccgataccggcggcttcgatgacggcgtggtcaagtgccacctcgagtacctcgccgcgtaccgagaaaatcaccgggtggccttaacctcgccagctaccttggcccgataggcctgacggtgccgcgcgcccagcgcttcggcttctgccatccgcgcgatcattggtgctctccagcagtggcagatcgccagggccaacgcgtcggccgcatcggccggtgtcggtttagcttgcagtgcaaggattctggtcaccatcgcggtaacttgcgctttgttggcggcaccattgccggtaactgcggccttaacctcacttggggtatggaaatgtacgtcgataccgcgtctcgccgcggccaacgcgatcacaccgccggcttgtgccgtacccatcaccgtcgacacattctgctgagaaaaaacccgttcgatggccataacatccggatgatgggcgtccagccagtgttcgacgacatcgctgacagccagcaagcgcttggataccggtgcgtccgatggtgtgcgcaccacatcgacatccaacgcaacaacttggctaccgcgcccattttcgacgacagacaacccgcaccgcgtcaacccgggatcgacgcccatcacgcgcatcacatactccccatctaacagcgcacaatgttcgatagcctagaggccagtctagacagcatctggtaggacacgcggtagcatggcttgtcggccggcccgttacgctgccgagcccaccgacaaatcttaattctattaggtacaggcacgaaaaggtctgtatgagagaactgccggttgtccttgctacggtgctgctcactgtatccatcgttattctcgtcatggctttgcggcgacccaggaacaacggcaccgacaggctagcgccaagacctgctttcttgttaacacaatgccgcaattcgcgtctcggcagttcggacctggaaccatcttcagttacggcaacgtggactaaaccagtttcgtggagcggtcacctatcgtgaaagccccttgatctggtaggagcatctgctgaaaagttgcgaccagctgctctggttcagcatcgaagacgacgatggacgcctcaaattaataattaatgtggtttacccacaacgacatcaagtggttgcgtcccgacaactaacaagtagttgacggcgtgacgtttagccgatccgaacgtagccgcgctagctacaccaccgaagggacgacgagcctaccacccggcgggagatggacttcgtcgactgcgccccacgtcaacgagaccgcgctgatgtctttcgagcgctgggcgccggattataccgtggtaaatatcgaccaacaagtccatgctaaccgactaacgcaccatctaccccgcgccccaactatacagcataagaccgcagaggattaggtctggtgcctgctttcatcagctcaccatagttcctgccgacagcgacggcagaaggttcggacgcgcagcacttaacgcggccgcggctaccaccttacgttccgcaccgaccacacacgactagaagacgtttcgtctgctcgcaaacagactctacgaacgatgcgcgcagcaagtcaggtggcttggtgacatgttccccggtgatgatgccacgttcatcgcatttgccgccgaacccgccggcactgactggcgctggcagacgtggcacctgtatccacgatgtcctttgaggtcccggagggacggtggtccacaccgcgagccggtggcgtccatgagtcgcaatcgtctttttgtgattgcctgcactctgatcgtcgtcaccacagtgtcgctgatttcagaatcatcttgccggacaagaaaattagctcgtatattgcatcacgctatcacgaacattcccatgatgtcaacggaattcgctgcgtctgcaacggatcacccacccaagtaatagcacagacacacaccggctatcagaaacccgaggcgcgcactgccaacaacaccaaccaatacctgcgctacagcaacaacattgtgaccgtaggcttgttcagcaactacatgtgcaagcatccgcgtcgaaccgctcagcgccggatacagtcacggggcgttcatattcctcggccgcgggttaaccccaggatcaccataggggtggtaccagacggaggtctcgccccgaaaacctcagcggaaccaataaggagacatacagccatgaacttcaccgtccagaccgacaccgtcaacctcaatcccatcttgcgcggcgtggttgccagcttcctgtacttcctggtagtcgtagccatcctggccaccaacttcgtcacggtcgatgcgttgatcccaggacagttgcagcaaatggctttaattaaccgccggcctaacgccgtcgtcaccatcagcaccatcgccagcggcgtgagccagctcagtcaggggctcgtcggggtggcaatatatggtttcatgggcgtggtcatattaagggatatctctggttgacactagagcatagtgacacccggcaatttccataaacacgtcgaaaaacccgagctgcatccggccccatgttcgcgacggctctgatgctgctgttagtgcggggagtaaccgccaccgcgctgtcatgaattctattccggtgctcgcaatcagctggctcaccgagttgccacgacggtggcgagccgtgcttctggccgtcgtcgccgcgtgtgtgacatgcggcatcatctatgaactcgcacaaccgaccctgccgacaagcttgaacggcagcggcatcgtcgcaacttcactgatcgtcgcgagctacatcgccgtgttgggtgctgaggccttagcagtcaaactgctgctaacgcacatgcggctatcacattcatcgcggtcgatgcgctgccggacatcatcaacggcctgtctgcagcggcgctctagcgtttatgggcggggttaacacgggtcctggcggtgagtacagcgctgatcgatcgtcttggtcggtgccgaggtgctgctgcaacgcggtcctacgaaccccgctacggatatcgggatatctccgccccaatcatcgcctaccggcacaccggctgtctaccaggaggtaggtaacccaacgtggtaacgacatacggctgtacttggacggggttctgcagttttccacccaggacgactaccagtacacctagagcctcgtctaccccgcactcggtaataatgcatactcggtattggtgccagacgccgcgcccggccagtaaccagtaacttgtccgtttagacttcaaggtgtcgtcgtgatggtcatttggtggttattttttgctggtttggtttgggtggtgttgtggtgggctggtggggtgtgggtggttgatctgcgctagaaggttgccgtatgtgccgccgacggccggatcatcgatgcactgttcactaacacgatactgctgcacccggcggcatgcctgcttgctggctgagggccggtcaacaagccgccgacaccgataccagcggcagaaatggtgcaagggataacatcaggtgcgaatagttataccgtgcacggggacgtgcctgttcaggtgcggccacattgaccacgccgacacctcaaggccatgacatgcacactaaaacgcccctaccccgcggcgctaacaactatcctcacacccacgcctgcatcgatatcgccttcagcacagcccaggtgcccagcccctggcatcatcaacatgtagaccaagcagcacccaccaccgacatgcttacgtgcgccgcgctaatcgtgtccactgcggcaaagcacacgaagcctcatcgaaagcaggcagtcagccacccaccaacaaaaaccccgcaacacagcaaaacacgtcaacaggattccgggctgccccccacgactaccgaacatatcggccagtcataaaacgcaaaaacagccatttcacccaccacctatgaaaccaaccgaacaactcaccgccacagacacaaacacgacagcttgacatcggcacaatcgttcaagtggagctcaatcccgcagtgatcaacgtaagtaacgcgcaccacactgcggggcgccaacagcggcgcctggacaacccgcggtggccgtcgtgatctacgacccaatgaactggctgcgcacctccactgcgagcttgcgctcgcggaggctttgacacagttcatcatcgaccttaccgaccctgatacccccatgctgagccggccgtattccaacgagttctgtgtatttggcgcgcatgcgctggctcccgcagagctgatggtcgtgcaggaagcccgttttccaccccgacaacgttttggaggatagtctcgacgatccccggccggcctgtgctatgctttatcatctctgcgtgcccatcttaggttattggaaatgtgtcttggcacccccgggcgacactgcgcccacacccggcataccgaaacaacgtttagccgcggcgattcttcaacccgcaagtgctcgagaccgcaaccgtgttctccagcgacatcgggccgctgacacactcggcccgtcgactttccagcacccaagcaccatcgaagacaggcgtcacgactatcaaactaatggaatctgccgatggccagagccgtcagtggcttccgatcttactgcacccttgacccagtgtgtcccgctgtagctcactcgccgtcaagggcggccaacacctcgtcggatacatcggcattagtccagacattatgcacgtcgtcgctgtcctctagcgcgtcgacaagcttgaataccttgcgggcgccatcgaggtcaactggcatgctgaccgacggctggaaactagcttcagctgactcgtagtcgatgccggcatcctgcaacgcggtgcggaccgcaaccagatcacctggctcggcaatcacctcgaagctgtcaccaaggtcgttgacctcctcagcgccggcgtctagcaccgcagcgagcacatcgtcttcggtgagaccgttcttctccaaggtgaccacgcccttgcgagagaacaggtaggccaccgaccctggatcagccatggcaccgccattgcgagtcatcgccacccgcacctcaccagctgcgcggttgcggttatcggtcagacattcgatcaggaccgccacaccgttgggtgcgtagccctcgtaggtaatgacttgccagtcggcaccaccgacctcctcgccagcgccgcgtttgcgcgcccgttcgatgttcccgttgggcaccgagctcttcttcgctttctggatcgcatcgtagagcgttgggttgcccactggatcaccaccaccgacgcgagccgcaacctcaatgttcttaatcagccgggcgaacatcttgccgcggcgagcatcaatgacagcctttttgtgcttggtggtggcccacttggaatggccgctcatcggtgtgtagaacctcttctgttacctgacagtcgcacaacaagtttacgtgctagctggcccgcacacttacccctaccgcctaagaatgcccaagcgtcacagatttttgaggcatgtcggtttgtaaggagtgataacgcatgcgctatgaatttttcgaaatcaccccgtcacctgttgatggtgcagatgtgactgatgtgcactttcctgaaactcaggcgattccgttgacaatgtcaacgaataactggtggatgcgccggtcgctggtcatctccgggtgaaacgccgtagccaacattgagccctgccgcaccgcgacagcgtggcccgcagcttgagccagcacctgcacgccatcgccggcccgttccacccagggcgcacggatgaacaccgcacgcaccggatcaacaagaccagcgaacccaatatcgccttcaaatgaatcgacttggcgtccaaaagcgttgcgccgcactgtaatatcgatagcacccaacggcagcgcctcacgcccacacacgccagcgtcgaggatctcactggccagtagaatcatacccgtgcacgcaccgtaagccggcaacccgtcggccagacgcgcacgcaacggctctagcaactcgcagtcgagcagcaggtggctgatggtagtggattcgccgccgggaatgaccagcgcgtcaacctcgtccagctcaccgcggcgacgtaccggcatggagtcggccccggcttcgcgcagcgcggtgagatgctcacgggtatcgccctgcagcgccaagacgcccaccctcggaaagctcacaacacgctccactgcggagtcagccgggtatcccgcgggaaaacggatcagcccctcctgcatgacggctgccaccatagccgcgttgtggcataagcaagcgaaaaagaggcatttggaacctgttacgactcaaacagttcaggtagctgctcatttagcaatgcatccaccaccgtgatcaatggacagccggcctgttggagagtgtcactcggactcatgtttgccagcatcccgtgatacgggggacgattacgtcagcagagatgcgtatttatagccttgacggcgcgtagatgtgcagtacaccaattcgataagttcctggtcagcagtcgctgaccaggaacttatcgaattggtgtactagtttgcgcaagcgcaacgcacaaaggtctgtactgcactcgtatataatccgtgggacctgactcatcaggcgatgatgcgagacacctggcttggttccgccttgcgtgactggttcagatgtgattgcagcaagccgaaaccgataccttcaattcctcttgaaaacctaatccatacttagtttttaacaagaatgtacgtgatggattattcgacgaactatcaacaagaacagcttcttatctaatgatatagaattgagaaattttcactggaaacagtgacctgctgtccgacctgtcaccggatttcgcgttgcagcttgtcgtgaagcgtcgaacccgctgccgagaaccccttacaagtaccagacatccgaaccaccaaattggctccaagccaacgacaccaattcgactgatccgacatgcgattcggctagggcgccgatcaatcccatgagtagcttgctggagatttccgccaagttggcgaagtcatcggttaccacatcggcccaccaagttgccgggtgcagtagcgcttcggcgagtgcgtcttggacctggtcaccaagttcgctccaactgcttccgatgctaagcgtgatcaacacgtcgactgtacgcacgaccagctgcccgattacccaactgtccagcagtgcaccaagccgaccttgagcttgtcgaacggtgccggccaggcgggaggttgtcggacgcgatcacccagagcagttgccgcggttcagcgatggccatggagtgcatcgcaatcatgcgcaaggacccgtcgtaatcgatcatgcagtgaacggcatcgcccaagcaaagacaaacatgcaaatgaacgcgaacgccggccatcgtcacgagttgctctcgaggcacatcacagcaacggtcgacatgcactacaaggcgaattgaaatacgccaacagcgcgatgaccgtcgacgcggtaaattcccggtaccactgatcatcagttatggtggccaacgcctcaagcagttcgtcgggatttgttgccgccaccacctcgccgaggatggatacaaacacctcccaagccgccaagtagccgaacaatccgacgtcggtgagccagccaaagccgagtagcttgaacaccggctagacgaccttgccaacgtccacagcgtagctgtggtctatctcacatatgcgatgacgtcgtccggggacagctacgagatctcagcgtcacgcggtagcagattaaagaacgcccacaacatcactgacatagccaagaggatagtgggcttatgcagaaacatcttctccgcaccccacattgtcaccagcacagctttggagtagaaaaaccgataaggtggaagctccttggtgaacggcagcaagtcgctgcgcaggatcgtcgacttgaacatccacgcgatgaggagcgccaccactgagatacaacaaaacaccaccactctctgcgcgctgaggcctcaccagcttctatatggcgcgcacaaaacaccgatcagcaaagtgaataccagttaggcgagcgtgataggtcatcagcgacgcagacaggtacggtggcgattcggtcgctttacgatggcaacgttcgggtagccataatgcccgagaccgcacaggcgaacgagtacagcagacaacaaaagcgcagccttccagtccggttttgaccattacccgttccatgagaaacgcagctcgtgccatatagcccacatttccagcagagcaatcaacaaaaatatgcagtgcaatcctcgggatgaactgcaggacaatgccgacaccgccgatgatcccgtagccaagtagacctgtcagcacggagttaccggaaagatcgccgaccgtgccgcccagccagacaagcacttggtagaccaaatcctgcagtggcgccacagcggtgaacacgacctagaagaacacaaacataaccgcgaaaaagacgacggagccccataacggttgcaacccaacttgttcaattcagattgaactctgatcctcttgtggcacaaagtaatcaacgacattgagcaccgatcttccccgggcttcggcagcgtcgtgatcagacggtaggagatcggcggccgctgccatcggctacctcgtaacccgtctattacaccgtgaaccacggtgcactacgattgcagttacaaatattcccatcgctgccgacaacgcatcgatgtcgacccggcctgccagggtggttaattcgtcattcatagttgagtgccagtagcctactcggagcgcctacgccacaaaaaggatcgaacgacgaagcgtggtgacgtcggtaaccaccacgatcgcatcaggacggtcgatgtcgtcgagctcaccggagagcagattgcgtaaccacttgctcgtccgggctgatcgtctaaatattaggtgtcgggaaagtctccgacggcgttggtgacgccgttgaccttgatggtgcctacactgcggccgaccgttacacccggatagtttccagtcttttgcgcgtaacctggtcaaacgattgaacaccttggtcttgccgacgttcgaattgtcgaccagtactactcggtgggtacccgcaatggcaattggccgcgatcgccaatgtagcaagacgtcatcctctgtgccactgggacaacttcgatcagtcgcgcttagcggcgacggagacacagttcgatgtcttgcacccggtagattattggatcaccaagtggtgcgcgacggatcgctgtgatagatgcctccgaaagaaaacctagttgctgtagccgagtcgctacggcagatgttgcgtggtgtagcgtgcctaactatgacagccagctggccgagcaccaaatgagctatcgggatcaccgaaccggacaggtgcgaactggaattgaccctatgagatctgcctccatctgagcatgatccgtcctaacatttcgcctatattttggctagatatacctaaaccgttacattatttacctccattctacgattcttggctatccgcacgtgccagtggctgcgtacgaataccgggttgcggtcgcggtattcgtcggggaccgagctaaggtaatcacgacaacgataattagtgctgctacaagaattttgcggaaggccgttacgtagcatgcagcgtacagaagtgcataactgctggttccagcccagatcggtaccacacccggccttgcagttttacgttatataactagttctgctaaataaaaatggtgcaattcgtagccaggttcgtagtctccagttgtgttgaaatataccgacaacctgacatcctggttaagtgcaagagtgttaaacaggggttaaataacggtagcttttctcgctggttgataaacgaacagggagaattgcaatggcgggcaagtttagagatcagcaaagacaaggtgagtaagttctggttccatctcacagtccccaatgatgcaattacctccgctaatcaattctatggaataaactccaacgtagaaaaaatatatagaagcggttaaaacgcacgcacctagtgttacgacccggtgtcaatatcggcacaaaaccgctacgacgcagcgaccgataagacgttacttatctacctgcggatattgcagtagctgctggagtcaggaatgtcggcatcaaaccttatttcttagagtcttccgaccggaatggaatgctatatgttccgtgagcgaggaggtttgcggtaggtcaccgtacaacataactcagggctccgctgttgattcccgagatctgctcacctaaccttttcagactttctgcacaacaccctttggcaattccgtttttctgtacaacaccaccaactggtacgagaataccctgcacgcaccgacctatgacagcacttactggtttggtaccgaagttagtgggggaagatatcgaaggcggttacagcgactcgacaaccaaatcaagcgcaaagtagagcagcaccaaaatgaacttgccgccaaatcggtcgattatgtgcggcttggtaccacaataacagaaatctttcgtaataacccgcgggaaaccaaatgattccattaccgttaagtacaaacgatggcaagcgggaattttgtgtcacgatttcgttattatttgccatccacggtaagtctactgttgaattactggctaatccactgcagcgcagcttcatactatttttgtagtaacagatctagtcaaaattcttcaccataccggtggaaaaaatcaatagctttgcttgatctggaattctatatttagactgaggtccttgtgtatagttccaccaaactgtgtttacagaatcttttagaagtcagcgatatttagtggatcaacatgtgtgggcgaacgcaatgtttttatcaccacctagtacaataaaaacaacgataattacactgatgcggattgtcagtatggactaatgggctttctgtacgccaatgatttcgcttaccctaacataatttatcatcacgcgtgtgactaccacggctactagcatccgagatggcgcactgtaggaactatttggaaatgcagggtgaaatgtggacccggtatattagttcgttaggctgctcaaaatctaccgaaacagtgctggagttcaatcacttcatggtcgacaaagccgcgcacactaccatcagaggtggggagagcacagtttgattatgcggaagggtcagctataccactgaggccaccatcagtgcctagtaccgctgcatcggccctctggtttgccgcagcattatctaggctgagtaacaaagtacgttgacgcgccgacggtgtgatgtgcggcctgggtgcatgccgcattgagatatgaaggtgattccggttggttgaggaagtatctagcggatgccatccgggtcaatgccgtggtgtcgagagacgcctcaagcagggtgttaactggtcgcaagcgcgacacaaggcgtttcatattggcggcggaaagcccgaaccggactagtcagcgatccgtgagtgcgacaaaaaacttaattttggagtcactctcgatcagaacagactgcaggagatagcccggttccgtgctccgcagccaatgaacacagactggaggttagaggcgaccatgctttccgcatccaattgccgttgcgacaacgcagtcggcagaaatcaaggaacttcgctgacttgatttctgcgtgaccagctctacactaccgatctcactcctttgctgacaatgcaaatgctacccgcgctggggtggtcaatcaaggtgttaggaagccacaactctctaccttctcaccctccggatgacaacgagtgtggcaccgataacgagaccaatatcccggtaagcggtaagtacgatgaactatggtagctagtcaagcagggatcggcgtgctgaacctttgagtgcccgcaaagccatctcgttgaccaggtcctcaaggagagcccgcatcaggcgatccagtacaatttcggcccaccgttggtccgcgccgatgttgcacccacgctggcgccggtgcgagaagtgtcttgtggggcaaaacacggcaccatgcaacgacacccagcatgtgttatcggcatcatcgatgatcaattcggattctgaaggtgcctaaattcctcgtggcctttctctctaataatgctgctggaacttggttttaaagattttaccgcttgcatcgcggggtatcgctgctaagaaataaacgactttcagacatttgtagcccaccagatacttgtgacaaaaattcgatgatgtcatccaggttccatttcagtagtggtgatgacaacgatcgccttgacggattcaccacagaagttataagaaatacctattaccgtggcatcataaacagcaatatgtccgataagcacgcttccacctcaggtctgtacacgtttctcgccagcgccgattatcatgtccttcaaccggtcctagatgtactatatgtatgaggtaaccatcggcgccgaggtgaccgatgtctccggtgcgcaacctagacatctgtggtaatcgtgtcgacagttgcttgtggctgattaaaatagcggcttatgcgctgattgttttgtatccagatctcgccggattgcctgatagtttggttagttacctgattcgggatcaacgctctcgatttcgttgctcagcaattcttttacgggttacagcaacacgttgagtagcctgtaatcgcggtgttttcccgttaggggcggtgatcgcgctgcaaaatttcttttgtacttacagctggatgaaattaatgcggggccaagctgcgagcactcgccatagcatagaggcatagtggctgttacatacataacgtagcgcaagccggagaaggcactcaccgccacgtgaccgacgtccagaaactgggcaatcaccgggggcatcaaagatgcataagtgtcccggaattcagggagccgattagtgttgcagctccgggttcgcgggccaggctagttggcgccttgaccctgatatcaaaaatgcgtacgaaaacccaccgacgtagaacaggggccatcgcaaccacgttcgcgtcccccttgcctaacagaaacagctggaccaagctcttgatgtggttgaccaaggcgcgtcggcttaatacgaaccctttgggccatccgggaaggcccgagctgtagatcaccagggcggtgtcagcgtcgacactatacgggtcggcggcgaccgatatagctgcaacgaaacaggattcataagggtcttcgttctgactagggccatagccaccacaatgatgtgtactaaaaccggggattcgcgcactaattagctcaattgatgactgcagtttggcaccaatgaaaaacactcgtgcgtcactatcgttgagcacatggccgagttcatcaccgattactcgccaattgacgatgttagccaccgaaccaatacaacgcggccacaagcagaatgtcaaagcaagccgggtggctttcgtccaggaaataccacacactggccacgccgcacaattggctgcgtggagcgcgcccgctgcacgacgaatacgcgacatccactgtgcccaggaccactgtcactcaacatagtgaatcgctatgtaatcggtactgtaccgggcgccgacatgtgatataaatcccctgatgagtaaatggcattatagtgtacactgccgctagtggcttaaccatggcgtagcctgtactcaatccaccggttgattcgctcggcatctccggctgcgttggccagcttgcggattgggttagtcaaatgcattccttgctgcgagtcacagccggaaacgtacccggccgagcgtcggcagcacaccccacgctttatcgtcgtcgaaatgcgtgacgctcgccgacttctgttgacaggtgcaatctgtagagcagcttgaggttaagtgctgcacgtttatggtcatcacacgatgactaaccatacccgaataggtaaagcattgtgcaccaaacagatccggtcagaagtcggcagttgatcgtcagtttttttgctcataggagcatatgagcacgggaggctggcgaataggtcgagcgctacagtggatcggtgaacggcacgtggcgcacaacaacctggtcgcattctgaacaccaaatcttgatcgcggtccgggaaccaaactacgctgacattggtgaacttggcccatccgtggtattgctgcacagccatggcttgacgaaaaggctaggtggtccggcttattttcatatccctgttaaggcgcgtggctatcgactggcgcccttaccttagagttgatttagatacccggtcatgttcgtcaataaacattctgacaggtccgttcccggcagacttcggagtttttgaggctcggttgcccaatacccaccaccacgccatcgatggcgccaagacacgttagtcgccgtcaagtacccgttccacttactgcgttgttcatagacgtcacctgtcaacggaactctcgccaccggatccctcctccagcgatcggtgatgaccgggtcaacctaaacgagtgccgtcggacccggtgggctcaatcagcaaaaagctcggccccggtcaagctccgcaccggaatagaccttagtcacgaagtgcctcgcgccggaccacggtggtgcgaggtgatttagtgcacggttattggcggtgcaacactacgtcggactaaggtcccggggtgttggtttcacacttggctacgataggcttggccgggttcggtgctggcgcgatcaatgcgctcgtcggatccggcactttgatcacgtttccaacgctcgtcgcccttggttactcaccggtcacgtcgaccatgtctaacgcggtcggtctagtggctggcggtgtatcggctacttggggctatcgtgccgagctgggcgatcggtggagtcgattacgctggcagatcccgatgtcgctgaccggtgcagcgctaggcgcctttctgctcctgcatctgcctgagaaggtgtttaccgctatcgtgccaatgcttctcgtcctggcgttggtgctagtagtggccgggccgcggattcagtcctggacgcggtgtcgggccaaagcggccgttaaccgcgccgaacacaccacaccggcccagatggctatgctggcgcttggcaccttcgctgtcagcgtctacggtggttacttcactgccgggcaaggcatcctgctggtcagcctaatgagtatattgctaccagagtcgatgcagcgcataaacgcggctaagaaccttttgtcgatgttggtaaatcttactgcggcagttggctatacgctggtggccttcgatcggatcaactggtcggcggccggcatgatcgcggcgagctcactggttgggggattagttgggacccgttacgcgcgccgactatcgccgaatgttttgcgggccaccatcgtggcgatcggcctaatcgggctggttcgcttgctcgcggtatagcgataaattaaataccaaagtgaggaattaacaccggtatttggggcatggttgaggccggctgtgctacgagggcaggccactgtggagaaccttaagctccgataggtgcaccggtggctcgagtgtggacacctgcatcgatggtctagggctgggtagttgcagcagcgccatcggaacctgtaccggtggactcgataggtggaccggagaacttgacaggttcaccggaggctggatgttcggaaccgatagtgggaaacgcggtagcggaagcgggacaagcaccggagccgctggaacgggtgtggggaccgacgaagccgagaccagtattgcgggcataggtgcagtccggctgccgcgttgcaacatgggtgggcatcggtgaggacagcggcgcagactcatgcagcgaggtaagcggaggtctgttgggccggcacgataagattctgcctagggctagacggcaaagcgaccgtcgtgcgaatgttgatcatcagggcgactgccagcaccagccaccgcagcgatcaacattgccgccaacgtgatgctgaccaacagcacaggcttgcgttgtttccgggtctagtctggcgtaactagtcggatatcacagtggtgttggccgttggcctttgccacgtcgttaacaacactggggacatattcaagacaaccgtgccgacatagaaattacgcgtaagtcagtgcgccggtggacgagacgaacaacggcacgatgactgatggccaaacccagcccggcgagctagctcccctcacggcaggcgtcaaacggaattaggggcggttaggtttagtgccggcggtttttatactccatctcaagttcggcaattatccgtgacgttcgttcgcgcagcaagattgcggcgatgatgccgaccaccacggtgatgatgagcgcgatccaagagaatcgttccatccagcgttcggcggccatcccggcgaagtagaccagcgcggtagtaccgcctgcccaacaaatggcacccgatacgttggcagctagaaagcgcgggtagtgcattttcaacgctcccgcagcggcccggcgagtatgcgcagcaacgcgataaaacgaccaaagaagaccgcccgcacaccccagcgattaaacaaccgctcgaccaacgcgacatgccccggaccgaagtgcttcggaaaccgccggccaaggtgatcaaagagcggcatgccaaatcggcggccaatagcgtagccgatcgagtcgccgactgcggcgccaatcacagcgacgacaccgacaccgatcgagctgaccgccaggtcgtgacgcgacgacaacagcgccgcacttaccagcacgacctctcccggtaggggaatgcccaaactctcgaccccgaccacaccgctgaccagcaggtagactgcaagtggtggtattgactgcagcagagcatccacgtccatacatcaagaatgcccgaccgggatgcgcgccgcaggctcttagcgtcaagttggcgcgtcgtggtgttctacgtgtgacgcgctaacaggttctaaccgcgggcgtttaggtactcgcccatcggctgaagatttgccacgcagccatcgccacacccacggcataaaaatttcccgcatccagcgcagctgctcatagctacggactccaaatggcacctgcgcatgattaccgctcgcttcggcccaatcatggctactgttaggcaaattgagagcttcggcaactgcggcagcaacacagaatatgtcccttggtggacgcatgtacgcggtcgatgtcc

SEQ ID NO: 126 - DNA (genomic), 42157 bp, MYCOBACTERIUM LEPRAE; double-stranded, circular
  hypothetical: NO
  anti-sense: NO
ccagtacaccatggccacgttcaagtgccgcacacgcccgttgctgaaagtcgtcgagcgagaagggcaattccgcggtgaaccgggccagctcggccaggtcagtcatgctgccgcgcgcggcgcggacctttatgtgacatcgtcatgagacctagtagcggtatacgaccgctccggtatcgacgagggtggctcgatgacagacgcttcatcgtcggcgattaaggcttcatgcttgactctgcgcttgtcgtgcagccgaactagctggatggcaagctcgagcagcacggtcagagcggcgccaagcgctgtcatcgaaaatgggtcagatccgggcgtaaataccgccgcgaacacaaacattgcgaatattagaccacgacgccaagacttcagccgctgataggtcagaagaccagcgatgttgagcatgacgatcaacagcgggaactcaaagctgaccccgaaaactaccagaaggttcaacaaaaaaccgaaataccggtcaccagaaagcgcggtcacttgcacgccgctaccgacaatcagcaagaaacccaacgctttggataacaccaaatatgctagtacagtaccgccggcgaacagcaccgcggctggaaccacgaaagccaccgtgaagcggcgttccttcgtgtagagccctggcgtgatgaacgcccagagctggtaaaaccacactggggaggccagcacgatcccggcggccatcccaaccttgattcgcagcatgaattgatcgaacggcgctgtggccaacaatcgacactgcccgtcggggctgatatccgcacgtgccgattgcggcagcgaacagtacggacgccgtaaccactcgccgagactctccaacccgaagatggaatgagagtaccagatgaacccgaaaatcgtggtgaccacaatcgcggccaacgagatcagtagccgggttcgcaactcagtcaggtggtcgatcagagacatcgtcgcatctggattggtgcgactgcgcctgtaatgctgcttgattcttttgagtagatcacaggcacgcactacagccctgcaaccgttcacgacgtttggtcaatgacgctctaggattacgacgttgctgccgtgctaagccggccgcgcctcggtgtgatcctgctcagtcgaccatggcgggacgacccgctgggactgcacaaccgtggggttctgcattggtgtctcaagggcagacgcttgcgcctggttctcggtctgcatttcacgtagttcagacttaaaaatgcgcatcgacttacccaacgagcgcgcagcatcggggagcttcttggcaccgaacagcaggaccactacgacaacgaggaccacccagtgccatggactaagactacccactttaaatttacctccagacatccagtggatgctaccgcggcaacgccacctatcggcgtccgcaccacagcatcacgcctgagccgtaacctggtaggactccagagcagcgaccgcagcattccgcacgcggtacgcgagcgcctccggtgcttgtacttgcacagccgacccaaatcctagcaccaagcgcgtcatccaagcatccgaagcgtatgtcatgaccgcctggaacgatccatccggcaactcatgggcctgccgcatcgggtagtactcgaatatccaggacaccgaacgcgctacccacagcgtcgccgacggcagcaacgggtcgtcatcgaagaacgatgtgtctggcagcgcctccgcactgtttcaggtgcagcggccggctcatccagctcgcgggccaccacgatccggtcgaagcggaacagccgaaccccttcggcttcgcgcgaccaagcctcaaggtaactgtgatcacccaccaggagtactcggatagggtcgacaatccggctggtcaaagtgtcatgtgacgcagagtagtagtcgatcaccaatgcttgtttgttccgcaccgcggcacgcactgcggccactgcgtgactctcggagaacggccgcgtatcgactgaggccaccgatccagtggcctcgttccccataacaaccgctgcggcctcgatcttggcgatcgcgctgcgcaccgcctccggatcaaccactcccggaatgttggccagtgcccgaagcgccaccaacaggccgatggcctccggcgacgtcagctgcaaaggccggtcaatgcccgctgagaaggtcacctcgatggtgtcaccagagaactcgaagtcaatgagatcaccagggccatagccaggaagaccgcacacccacagctggttgaagtcctggtctagctgcttggcagacactcccagatcggcggcagcttccgcacgggtaatccgcgggttagcctggaagtacggcaccatattgagcagccgcactaggcgggtggacagctgtgtcatgaaggccctgttcccgcgtgggcgcgcaaccgtatcaacacatcgtcgcgcagagcgtctggctcgagcacgacagcgtcagcaccgtggccagcgatgtcacgggccagccggtcgatggatccaatgtcgagttcgatcacctgaccgtcgcggccgcccagtcgccgaacaccggcgggtcgtccggcgtgccgcaacgcagtggcccgtccgtcgacgacccacacccgggcggtagcgccggtcgacacttcggcgacggcgtcagacacgattctgcgcaaatcgacgccgtcaggcacggtgacagcgccggcaggcccgatcggcgcgacctccgaaccgatccgagagagccggaaagtgcgggtggcgttgcgatcgcagtcgtggccaacgagataccagcaactgttctcggtgatcacaccccacggttcgacgttgcgcatggtgtaaggctcagcccgtgacggccggtacggaaactgcactgcctgccgagaaccaatggccgacaacaggattgatagaaaatcctccgacccacgcagacttgacaccccagacgatgaggcgatgaccaccggtgtatcgagggggtcgatgtcaaccccggcggcccgcagcttgagcaatgcgccttgtgtcgcggtgatcagttcttgcgattcccacagctgagttgcgacagctactgcagccgcttcgtccggggttagctcgacgggaggaagtgcgtacgcatcgcggttgatgcggtagccctcggaggggtctagcgccgacaccttgccgacctcgagcggtatgccaaggtcacgtaactcgttcttatcgcgctcaaacatccgagagaacgcctctacggtaggactgtcggagtaacccgccacgctggatctgatcttttcagcggtcatgtagccacgggtcgacagcaaggcgataaccaggttgaccagccgttcaactttcgacgtcgccatgtatagctacatgctcgcgatcagccgcttgacccgctcgtcgaccgcgcggaaggggtctttgcacaacaccgtgcgctgcgcttggtcgttaagtttaagatgtacccagtcgacagtgaaatcacgtcccgccgcctgcgcggcgctgatgaactcgccgcgcagcctagcccgggtggtttgcggcgggtggttgaccgcgtcggcaatgtcttcgtcggtcgtgacacgcgccgccagccccttacgctgcagcagatcgaagacaccgcgcccacgcttgatgtcgtgataggccaggtccagctgggcgatcttcggatcggtcagctccatgttgtcgcggtcctggtagcgctgaaacagcttgcgtttgatcacccagtcgatctcggtatccaccttggcgaaatcctggctctcaatggcgtcgagctgacgggccccacaagtcaacaacctgctcgaactgcacgttaggctctcgggtttgcagatgttcgaaggcccgggtgtaatattcccgttggatgtccagcgcactagcttgacgcccgccagccaaccgcaccggacggcgcccagtgatgtcatggctgacctcccggatggcgcggatagggttgtccagagaaaaatcgcgaaatggaaccccggtttcgaccatttccagcattagcgcggcggtgcccaccttgagcatggtggtggtctcgcacatattggagtcaccgacgatgacgtgcagccgcctatacttctcagcgtcggcgtgtggctcgtcgcgggtgttgataatcggtcggctacgggtagtcgccgaagagacgccctcccagatatgctcagcacgttgtgacaggcagaacgtcgcggctttgggagtttgcagcaccttgccggctccgcagatcaactgacgagtgaccaggaacggcagcagcacatccgaaattctggagaactcaccagcgcgcacgatcaggtagttttcgtgacagccgtaggagtttcccgccgagtcggtgttgttcttgaacaggtaaatgtcgccaccgatgccttcgtcggcgagccgctgctcggcatcaacgagcaggtcttctagcacccattcgccagcccggtcatgggtgacaagctgcaccaggttgtcgcattcggcggtagcatactcgggatgactgcccacgtcaagatagaggcgggcaccgttacgcaggaagacattggagctgcggccccaggacaccactcgacggaacagatagcgggccacctcatccggggaaagacgacggtgaccatgaaatgtgcaggtgacaccgaactcggtttcgattcccataattcgacgctgcacatctttgagggtactggttgtttgagcatcgcggtgggcgagccacgcccacgggtaccaaccaaccatcaatgtcagtgccacccccctagcaacaaaagcatattcgatatatcaccgccgaacccgactgaactgcaccgtgttggtaccgcgtaccaaggactgcgcagctgtcgaagtggctgccgcgctgagcatcagccacggcaatgcctcaagacagacagatacatctcaatctcaccctaaatcgattgccgaaggtagcaacactgtttctagcatgagggctcagtacgcggttagcatctaccggtcacgtggcgcacctaatactcgtccacgacgaggaagcgctgcggctaatcgatgccaccttagtcgaactacacaaccgcatgtagtccgctgtcagcagccaaactggaaaaggccatcaacgcgtggatcgatcgctatgactctgatgcactgcatcacacacgcaccaaagcctgcagccgcgaagtgtgcattgacactggcgatgacgagaccggcaccaccgcgctttgggaccggctaacgtcaccaacaccgctctgctggattgccggccgatgcggatgggcctcccatagggtaagcgacgatcgctcgcacacgatcgcacagcgccacgtcaacgcactcggcacctcggctgcaaaaatatcgactgcccatttggtatcgataaaacgaacaggcaaccaatgcggtcatccacgttttagttttatacgttttagtatcgagacactcagcactagacgcgccacccgacccccgactttacccaccccacaccatcatcggacaaaccgcccgccgccctgaacactcgccgcggcgtggtgccatgtagctgttgtcctgcttattgacggcaaggccaaaatccgccaagtagcgtcatcccgacgctcccgagcgggtgagtagtgtctggtatcatcgccatagcggccccgctccgttgagtacgggagtcaaggcgcgcagcgcccgcggcccgatcgcacaaacctgggtagtcggagcgcttcattgcggtgctggaggacatttgggcagggcaaccaactaactaggcgcggccgcagtcaagggcaagtgatcactctcgaggttgaccgagctcggttactacgcagatacaaggcagcagggtcaggttttatcggatccggatcggttccccgcattcggaaagtccgaatgaactcatgccaagcaggaactggctaaaaatgcttgatacatagcgaattactctccggcgagatgctcgacaacttgatagatgtcttcgccaaactcggtctgtcggctgtctccagcccacgcccgggaactgccgctgggctatccgttcgtgaacaagcagatgcacaagtaaagtgcaggccacccaactagtcgactgcctggccagttattacgcttggcaagaagacgtcattgccccgagcgtatcagcaacaccatcggtagcattacttgaccagctcccagagacgagtttagcccctctagggcctgccgttaatcagatctactaggaccggttcatgtgctagcttacccttataaagggatagcagcgccgatagttgatccccgcgcacactgtcgaatcggccaaagtcgctgtcatgggatacgatgctcgagcaatgttcgacggcaagcgctatcaagatcaagtgggcatcgttgacgaggttaccgccagttcccagttacaccagaatttttaccaggaaagcggcgtggcgcacagttagacacatcaacaccgcgctcggccccgtcagccaatccgcgacctgacctatggcatcctctgaagacatcgtgcgaagaaccaaccccatcttggtcgcgggccgaacgaacaccaacaacgggacccacccgaatccgatgcgatcagcacacgatagtcgcaccgttgagccagcgcaaggatgacctgtgtgttcgctagacgtgttaccggaatacagcagcacgttcgcgtcggcgattttcatgaatagttatgatccgcgccggtagacgatgtggagcgagacgatgagataagaaggagcgacgctcatgaccgaagccgctgagacgacgcacgagttcctcgtcctcgaattcggccgcaattggcaaagcccaatcaagatttactgcggacaaggccaagtcagtaatacatgcggtaaaccggtgcggctcgaatcgccctaagacactgtcccgaatcacgtcgttgaacacctttttgaaggacatctgccgctcagccatccagacgccgcaccaaactgcttgacgtggtcgtccaacgtcaccgtcgtatgcagtctaacagcaatgagtgctgcaagtgctcgccgaattggccactaacgaccgaataggctgtacccctaatccgttgattcgccgtaggatttcgaattcttcgaatccctagcacctttgggattctgagcacccttggagcctttggaatccttttcccgcagcaatgcttccaacccagagccgatgatccgacgaaaagcccgccgcggccgattagcatcgaggacagccacctctaagctggccacgccaagggtaggttgatcgctaccggcggcatccgcactgcccgcccgcagtgctgcgaccgcgatccccagagcgtcggtcaagctggcattctcggcatacgactctttgagcgcgttagcgatcgactccgtagtgccacccatgaccataaaatgcggttcatcgttgatcgatccgtcgtaggtgatccggtacagctcaggcggtttcgtttcaccgtagtgcgcgacctcagctacgcacaactcaacctcgtaaggtttggcctgttccgtgaagatagtgccaagcgtctgcgcatagacgttggccaactgccggccggtgacgtcgcggcgatcgtaagcgtaacctcgagtatcagcgaattggatcccgccgcggcgtaaattgtcgaactcattaaacttacctgcggccgcaaagcccactcgatcgtagagttcactgatcttctgcagtgagcgtgacgggttctccgcgacgaacaaaacaccgccagcataggctagcgctaccacgctgcggccccgagcaatacccttgcgagcgagctcgcgctgctcgcgcatagcctgttcaggtgagatgaagtacggaaaactcatttctcactcccgccaaaggagccaagagtgtacgcacgtgaacggctttcgataatctcgcgggcaagttcggcgatccggctttctgttacctcggccgctccctcagcgccgatagtgaccgccgtagggtagatgccacggaccaaatccggccctccggtagcggaatcgtcgtcggctgcgtcatagagcgcctcgatggctaccctcaaggcagaatcagcatcggagacctgcgagtacaatttctttatcgacgacttagcgaaaatcgaccccgaccctaccgactggtagccctcttcctcgatgttccagccgccggcggcatcgaaagagacgatgcgccccgcgctctgcgggtcaggtgcatgaatgtcgtagcccgccagcagtggcagcgccaacagcccctgcatcgcggccgttaaattgctacggaccatgatcgcaagccggtttaccttgccagcaaacgtaagcggcacgccttcgagcttctcatagtgctcgagttcgaccgcgtagaggcgggcgaactcgaccgctacggcagcaatgccggcgataccggtggcggtgtagtcatcggtgatgtagactttgcgcacatcgcggccggcgatcatattgccctgagtagaacggcgatcacccgcgatgacgacgccgcctgggtatttcagcacgacgatcgtggtcccgtgcgacagttgttgaccaccgccagattggccgccgccaagactcaccggtagcaattctggcgcttggcgacgcagcaggtcgacgaacgaggactgatttatcactgaaattccgggaaatgccaagtttgtaggcagacgatcaggaaacgaccgggtcactgtccgcccttttgtacgtacgcgcgaacaaagtcttccgcattctcctcaaggacatcgtcaatttcgtcgagcaaatcgtcggtctcctcagtcagcttctcgcgacgctcctggcccacagacgtgctgctggtgaactcatcgtcatcacctccaccaccacgcctagtctgctcctgagccatcgccgcctcctgtttctagtctttctctaccctaccggtccagtccgacctttcccgggtcaacaggcttagtagttaattgctccactaattccgcagcgctgtccaccgagtccaacagcgctccgacatgggccttgctgccgcgcagtggctccaaggtcgggatccgaaccagcgagtcaccgcctaggtcaaagatcactgagtcccaactggccgcggcgatgtcggcactgaaccggcgcaagcattcgccgcgaaaatacgcgcgagtatcggtcggcgggttgttcaccgcccggagcacctggtgttcgttgaccagacgtttcatcgagccgcgggcgaccaacctattatacagccccttgtccaaccgaacgtcagaatactgcaggtcgactagatgtagccgcggggctgaccagttcaagttctcccgctgccgaaaaccttcaagcagccgcagcttcgccggccagtccagcagttcagcacagtccatcgggtcgcgctccagctggtcaagcacgtgcacccaagttttcacgacgtcggctgcgcgggggtcagggtcacggctgtcgaccagctttgccactcggtcgaggtaaatccgttgtagcgcaagaccggtcaattcacggccgtcgaccaacgtcacagtggcccgcaacgatgcatcgcggcttatcgcatggacagcatgcaccggccgggccagcgtgaggtcggtcaagtctattccgtgtactggaccttcttcgatcaaatcgagcaccagcgccgtggtgcccagtttcaggtaggtcgatgtctcggccaggttggcatcaccgacgatgacatgcaaccggcgataccggtcggcgtcggcgtgcggttcatcgcgagtgttgataatgccgcgtttcagcgtagtctcgagcccgacctcgacctcgatgtaatcggaacgctgggacagctggaagccgggctcgtcacccgcgggcccgatgccgacccgcccagagccggtgaccacctgcctcgacaccaaaaacggggtcaacccagctatgatagctgaaaacggtgtctgccgcgacatcagatagttctcatgcgccccataggaggcacccttgccgtcaacattgttcttgtacaactgcagtttggcggctcccggcacactagcgacatgccgagcggcggcttccatcacacgctccccagccttgtcccagatcactgcgtccagcgggtcggtgcattcgggggcagagtactccgggtgcgcatgatcgacatacagccgcgccccgttggtcaagatcatgttggcagcgccaacttcatcggcgtccaccaccggcggcggtcccgctgaccggcttagatcgaagccccgggcgtcccgcagcggcgattccacctcgtagtcccagcgggtgcgtttaacacgctgaatgccagcggcagcagcgtaggccaagaccgcctgcgtcgaggtgaggatcgggttggcggtcgggtccgacggggacgaaatgccatactctacctccgtcccaataatccgctgcatgacttgaagcctaggggacgcgtcgacggcgtacgcgggcgtgcgtctcggtgcgacgccggttccataaccatcggtctatacgccagagaagcgcaacggcgcaaaatccggaaaccgatttgcagtccatagttaacgtgcgaagcgttgacgtcgatgatttcgtagaacaggcagataactatgaggtggccgctctctccatagtaggaacaaaccggtttaagtccgataaatagattgcttcaacggcaagaaagaagtttggcactatatgtgcgaatacacaaaaatcggcggagagcgccaggctgcggtgaagcgcgcactacgcgctcgcatgttcgacagtgttgactaaatcgtttgttgctgtgttgcggggtttttgttggtgggtggctgactgcctgctttcgatgaggcttcgtgtgctttgccgcagtggacacgattagcgcggcgcacgtaagcatgtcggtggtggatgctgcttggtctacatgttgatgatgccaggggctgggcacctgggctgtgctgaaggcgatatcgatgcaggcgtgagtgtgaggatagttgttagcgccgcggggtaggggcgttttagtgtgcatgtcatggccttgaggtgtcggcgtggtcaatgtggccgcacctgaacaggcacgtccccgtgcacggtataactattcgcacctgatgttatcccttgcaccatttctgccgctggtatcggtgtcggcggcttgttgaccggccctcagccagcaagcaggcatgccgccgggtgcagcagtatcgtgttagtgaacagtgcatcgatgatccggccgtcggcggcacatacggcaaccttctagcgcagatcaaccacccacaccccaccagcccaccacaacaccaccacccaaaccaaaccaactatgacgatttcgcggattcacgcatcatagtgtacgtgacgcttggcctaaatttcatttagcgtacatttgcttgccagtcgacggaaaaacggaccgggcttaatccacataactccaagttatcgatagaactatttggttccctccagcaggctgatgtttccagaaaatttctccctggagaatgaaaatcagagccctttctcgttcaaaatacgtgccgacacttcccgggcggacaaacgaagtccatgtcagggatatcgtgcaagaaaaaattgaattacgttaggccactcaagcgcaattgtatacgcactgttcgaaatgcggaagatgttgcttgacatagtcttctttggccacctcatgcagcgtcagataaggcaggaagagaataatcgcaagctaatctgcgggaatcagtggatatcaatgcagctatccgactgtcctcgcattcgagatcagaaatgcgtatgttgaactgtagtcgatgccgaggttgtagagttaacgcatccaaggatcgaccatgcgcccactcgtcggtccattcatcatcatgcttgaatgtgcttttggcgccgtccaaggctggtgcgccaccggtaaagtgaaacggccccttgagaattacaggagcaatcacggccgttttcgcactcggacgggctgcaacaaaaatgtttggtaagactgaaaagaacatttgcacatcgggatacttgcagtttaggtctaaatagtctgcatagaagctatcgtccaactccgcgacaacttcctctttgcacatccacagcaggaacaagcgagcgtaaagatacaagatagcggatgacatctgaaagtgccaatcctctttaagtcaggccaacgatcaccaatacattccgctatgaaatccggccaagttgcaccagcgagtggagcgctttgccgattaatccgtaaacaagttggccgccggcatacagagaaacggggatggccgtttggtccatcgggcggtctttgtatacagggactacctagtcacgccgaccaggttgttgaacacgatcatacggtcctcggcgggcatgcgcaagaacaacttcagcagggtctgataacccacccgtgtacactcagcaaactaagctcggtaggctgatcctcagcaaggtgaacactcctggcttcgtcctccggcttgagataccgcttcgcataaaacaacccgcattccggcaccctcgggggagaatcacggcagtcgtgcccacgattccagatccggcaataacaacacaggcttcggcgatcatcttctgtttcatatgatctcaagtcccaaatagtactcggcttctggtgcaattctgcttgactgggtcgagtgccgcttgcaccaacgccgctagggtaagtgagcttgaggctttccctctgctaccgagcatcggcacgtgatacggcttaaagctggtttttggaatgcggcttgccggcagtggctgaaccgtcgaggctgctggcgacgactgtggttgcagccagccccaatcatggcgatctatggaactcagcaagcccgcactatgccgatcgtcatcatcaccgacggccaccacgtcgatatccaggttgagccaacaaccaatcaaatgggtaggcttgtcagttgtcgggatccctcttcctagttgataacggtcgtcagctggcggatgtccaggtaactatcacacggccaactatgcgcgatcacgacgaccagcgcggcagagtgacggtactcatggtaatcgtcaaaagcgagagggtcgctgacctgctttcatcggtactcgtggtagcccgcaataccgatcttggctaccagcgttttgggatccgtgctgggatgggcgatgcgcatgacaccgtcacaccttccgacagtaggtgccctggaggtccgaaccctcccgttgtgctgctaaccacactggtggttttcaacacctacgtctggattgtggccacgacgctcatcagggagcactatggctggcgatgatttttctgaccggcaccgcaaaagcacctgtgtcctctccgccaccatcgaaccgggtcaaaccgacgatgaagtcgactgtggagctgccgtaggaggaccgaaaggctggcccccggacactacccgtagcggcgatgctagacgcctcacccagtgccgcactcaccagagccgaacgtctcaacgtcgtcttcgtgatggccacttcacaactgatgcagatgtagatggtggcggtagtaaccgccaccatctacatcgtcctcgggctgatcgtgctgagtccagcgctgctcacagaacgtacacacaccagcaccagtggcgtgacacatgttggtcatgacacttccggcgccgaactctctgaatccatatgtgtctttcctcagcgcgttgatatccatctacattagctacattagcgtgcgtgccgtcggcgacgtggaataccgtgcagatattctgcgacttgccaatcgataatttacacaccaccctgattgcgcgaaaccgttaccgacacgagcacaccgatcgctctacaccgttaatcagatgagctgcaacaccatcttcatcgtcagtgcaggagaagaaatctacgaactgaccaatcctgagggacaatgctgggtgattaaagacccggagtcagggccgtgaccctcacctgccatggagatgacccagcctggcgccagccggcaggatcgacctgtcggccagatggaactaagcagtcgtgtgtgcctaccggacctgttgagcgtggacacgagaacccagccagcccacgtcttgcaggacgatctgaccaacagctacgcgcgggagaccgacagacctcaacgcccatgcctacaggtactggccgaggttggattcagtatcaattgcccggctggcactcgaactcttaccagtaaccaaagtgcgaatgtagacgatccgctcacccttcttgcccgaaatccgcgcccagtcatcaggattggtggtgttgggaagatcctcgttttcagcgaactcgtcaacgatcgagtcgagcagatgttgaattcgcaacccgggttgaccggtctccagcactgacttgatggcgttcttcttcgcccgatctacgacgttttggatcatcgccccggagttgaagtccttaaagtacatgacttccttgtccccgttggcataagtgacttccaggaaacggttgtcgtcgatctcggcatacatccggtcgacaaccttttcgatcatggcctttatgcaagccgcacggtcaccatcgaactcggtgaggtcgtcggcatgcaccggcagcgactcggtcaggtacttcgagtagatgtcttgcgccgcttcggcatcgggccgttcgatcttgatcttcacgtcgagacgcccgggccgcagaatcgcggggtcgatcatgtcttcgcggttggaggcgccgatcacgatgacgttctcgaggccttctaccccgtcgatctcgctgagcagctgcggcaccacggttgtctcgacatccgaggagacaccggtgccgcgggtacggaaaatcgagtccatctcgtcgaagaacacgatcaccggtgttccttccgacgccttctctctcgcgcgctggaagatcagccggatgtgtcgttcagtctcgccgacgaacttgttcaatagttcgggacctttgatgttgaggaagtacgatttagcctcgcgggcgtcgtcgccgcgaacctcagccatcttcttagccagagagttggccaccgccttggcgatcagtgtcttgccacagccgggcggaccataaagtaacacccctttgggtgggcgcagtgcgtactcccggtacaactccttgtgcaggaacggcagctccacggcatcgcggatctgttcgatctggcgggtcagaccgccgatgtcctggtagctaacatcgggcacctcttccagcaccaggtcttcaacctcggccttggggacacgttcgaaagcatagccggccttggggtcgaccaacagcgagtctccaggacgcagtttgcgcggccggctatcatcgttgagggcaccgggaacgccgtccagcaaattctcggcaaccagcggctcagctaaacaaacgatgcgttcctcgtcagcgtggccgacgaccagcgcgcggtgaccgtccgccaagacctcccgcaaggtggatacctcaccgaccgcctcgaaggtaccagcttcgacgacggtcagggcctcgttgagccggacggtctggcccttccgtaacgacgcaacctcgatattaggtgagcacgtgagccgcatcttgcggcccgacgtgaacacatcgaccgtttcgtcatcgtgagcggccaatagcacgccgtacccgctgggcggctgtcctagccggtcgacttcctcacgcagcgccaacagttgttgacgggcttctttaagagtgtccattaatttagaattgcgggccgtaagcgagtcaattcgagcttcgagctgatgcacatcgcgcacagagcggacactcccatgcggtccaaccgcatgctcaagttgctcacgcaacaccactatctcgcgtcgtagttgttccaattcagcaatatcgccgctggacatgcccgcttcacgagggggattgaatgcttcagaacgctctgactcacccaccttgcgctcctttcccgcaccgaaatagcacggcgaatgtttcaacgctaccggtgattgcctctatcgtacgcagaagtgaaatgccgccaaaagccgtgtctccggtagcgttggtaagctctgcgctgagttagccgatcgaaagggcagcggtgactatacagtacctcgccatacacatagcggcacatattgtcgtccgaggcgcgtgtgccagccatgtgatttcccttgcacccgctagcctgctgctgcagtcaatcgacgtagacgcgtagttgaacgtgtcgcgctggacgcatcgaacctttttcatcgccctgagcgctatcgtaaccacggcaggatttgggtcctcgggatgtgcacatggcaactccagcacatcagagtcggctgtcccatccactttcccaggcatttcgagttcaattactgctccgccagctactggcctgccggctccggaagtccttaccaatgtgcttagccggctcgccgaccccaacattccgggcatcgacaagttacccctcatcgaaagcgcaacccctgacagcgctgtcaccctggacaaattcagcaacgcattacgggacaacggctacctgccgatgaccttcacggcgaacaacatcgcatggtcaaacaagaatccgtccgatgtgctagccactatcagtgtcaacatcgcccaaacgaacaacagcgtattctcgttcccgatggagttcacacccttcccgcccccgcaacagagctggcagttatccaagcgaaccgcagacatgctgctagagttcggaaattcatcgggcctaactaacccagcaccaatcaaggcgccgaccccaacaccttcgcattgatccgcggtatgtggatcggctggctcgaattcgatgtgctgctaggcgacgtccattcactcaaacaaaagcggtcgctaatacgcccagttctcgctgagctacaacacaagttcagcgtgtcggccgctgagaccggttcacacgacttgtatcgccgagctggcatcggtgtggctatggtgtctagcgaccgcagtcataccgttgatgtgctcgatgccagcgaacgcctggtagccgcacatcccgagttcgagctgctccacgttcgccgcggcctgcaccacagcgacgattaagcccaagcggttctccggtacggtcgatagtgctaaatccgatagtgataacccgctacggtcggcttcgtcgcactcgcgatcatcactagctgtcacgctcctcaccgttttcaccgtttgcgaccccacggcgccggcgcgacagccggcgccagccggcgggccaaaatcaggaacgcggtgtgcccacgcatcaaatgctctggccgaaccgccagaccaaccacgttccaacccctctgaagcgtttcccacgcccgcggttcaacccaacattgctgaacccgcagagcctccacagcccgcgacagctgggtgacggtggccacgtagatcaccaatacgccgccggcgatcaccagccgcgagactgtgtccagcacctcccacggcgccagcatgtctaacaccacccggtcgacggaaccgtcgggcaactctgaattcgcaacatcactaacgatgagctgccaattgtccgatagtcggccttcggcgccggagacacaaaagaagttagacacattgcgacgagcgtgttcagcgtgatcggtgcgcagttcgtaggaaatcacctgcccctgcggcccgaccgctcggagcagcgagcacgtcagcgcaccggatccggccccggcctccagtacccgggcaccgggaaagatatcaccttcgtgcacgatctgagcggcatccttggggtagatcacctgtggcccgcgcggcatcgacatcacgtaatcggtcagcaacgggcgcaagaccaagaacagggcaccggtgctggatttcaccacgctgccctgttccaagccgatgatcccatcgtgggcaatcgagccgcgatgagtgtggaattctccaccaggggtgagcgacatcgtgtagtggcggcctttagtgtcggtgagctggacgcgctcgccaacggtgaacgggccagttgcggacacgctgtctagcgtgccagccgactcgccaccgccggtgcttggggttgtcggtgtcctgccctaggctgccgtcatgatcgaccagccgaagccacttcgagcggatctgtgttcgccacgactggcgctatcaccgtcgcgtgcggcggacttcaagcagtgcccactactgtatcggttccgggcgatcgaccggttgcccgaagcaccgtctgccgcgcagctcctcggctcagtggtgcacaccacgctgcaacgactttatggtctgcccgcgctgcggcgctgctcagacactgcgcgatcgctcgtggagtccgtgtggaaccagatgatcgctgcagaacgagacctggacggcgagctggatgctaagcagcgaacccaattgctggacgaagcccgcacattgctctccggttattaccggctcgaagaccccacccgcttcaacccgcaaagctgcgaacaacgtgtggaagtcgaactggccgacggcctattgctgcgcggctttatcgaccggatcgacgtcgccgccaccggcgagctacgggtggtggactacaagaccggcaaggccccgccggctgcacaagctctagccgagttcaaggctatgttccaaatgaagttttacgcattgacgttgctgcattcacgcggtgtgctgcccgcccggctgcggctcatctaccttgctgacagccagctgctggactatgcgccggatcgtgacgagctgttgcgcttcggaaagacgttgatggcgatctggcgcacgatccaattctctggtgaaacaggcgatttccgtcccaacccgtcgcggttatgcgggtggtgcccgcaccaggagcattgtccggctttcggtgggacgccgccgccctaccctggatggccggatcattcgcacacggaagccgtttcccgcctaacggaatcggcggcctagccgacggcgagttttcgtcaagatttgcgctggcacgaaaaagggcaagtagcctgcacgctgccgtcgatcttgccgtcgggaacacccaattagcgcccgggcactactcgagtagccacatctcctgcagcatcctgggaatgaaatgctgacgataggatggatatgcatcgtgcgcactagcgtggtgtagggtgctttggctgacatgacgtccaaaatgacgtgaatcgcttcgtcaccgtcgactccaaagatgttttctcccagggacctagtgggtatcggcgtcgactactgtactttatatagccttgtatctcaccttttccacttctatgcccaaccctagtcattgatcactaaccaactagtgccttgctgcccgatacgtgagcctgatcggcggtcatgccgccgctccccagcaaggagtcgatatacagcgcataggtggtgatgagttcattcaccccaagcgggtcatcgtcgatcaagttggcggcaacaatttcgtaataattgtatgatagtgtgaatgaaagcacccattgccattgcaatccaccatcgcccaaatatggtcgatattgatcttgagttggctgtcgactgcgattcagctgcgactgtcgatatgcacaacgacgacctcaaagaaccaggtcgtcgttgttaggccgccgtcccacggccaacaatagatgggtgccctgaatcggaacaacaccagtactaggtgtgagcgcaaatcctcaggaatcactgtgacgcttactaacccacatatcattagcgccggcgacaatatcgataccttcagcttccaggatctctctggtggcagttaagacatccctttcttcgcggaaggctagtcgtagactcctttcgacgaaccacccaggcttcgaagcgacgatacatctacacaaaatccaacacgatgtaactgcccccgcagaatgacgagatgggataacaacgtgacgaattcgagaatctatacaacataggtaaggaattcgatatcgcagagccccgggatgtccgacaccaccgcatgaccaccggcattgaggaagatccggtcagcgcgcagcaagtcctcgccgcagcagcgggtacgcggatcctcaaaagaagtgtaaccacgaaagacggtgcaggtgtccatgttatctaaacagatttcaacaccctaacatctttgcgcgccttgactttcgccatgtctcacactgattggcccagtgcttccattgtattacactgccacggcagtccaactacgcagcatgcgcgctaactaccaacttcttggttggaatgcatccggtgttgacacaggtgccaccgataattttgcacttccactatcgccacgagctgttcggcagccatcagcctgaccgtcgccgacgatgactggatcgacatgcttacccatagagaacccgtgagcgtaacgattgcgaaccagcccaagaccgtgaccgcatcctccaacagcacgatccagcaggtcctatatgccccgggcaacgaccagccgattgcgtgcctaaaaactggccaggatcccgaacacctcaccgacgaggacggcaccaagtgcgatccacaaatagcacctgaatgtacctattacgacgccgacaaacgcgcctgtcatgctccgcacagtaacgccggaggcacgatacaagtcaatgttttaggaagcttgtcattgacacagctctgtgaccgcaataacaatgaggatcacaacagaggtgaaatgacctacctcaattcgaggttgtactaaagaagttgatccagacgagtagagagctgctcaggaaactaccgcggaaacagtcagggaacatgactcgacgttaacaccaatcaaaagaaccaggtaatgcgtcacggagttcctcccgtcaagaggaacagctcggcaaccaatacggattataacccacagggggtgccattagtccgatggaaatcagccgtagccgaacgactaacacaacgaagtttcaaaaccggcaaaacctaatgtcagaagccagaatcgctttggctccgatggcggcaagctcgtccataatcccgttgatgtctcggcggggcaccaatgcacgaattgccacccagcctggctcggctagtggagctatggtcggtgactccagtcccgacgtgatcaacgtagccttgtccagtactgagcgcgggcagtcgtagtccagcatcaagtattgttgaccaaacaccaccccttggacccgagcgaccaattgatcgcgagctgcaacggtctcgtggtgatcgaggctgccccgatcaccacgctcgatcaacaccgcctccgaatcacacagcggctcgccaaaagccacgaggtcatgcaagctcagggtgcgtccggacccgaccacgtcagcgatgacgtcggccaccccaagttgcaccgagatctctacagcgccgtcaagtcttataactgttgcttcaatacccttggcaaccaggtcctttcgtaccaaattcgagtaagcggtggcgatcctttttccggccagatccgacgtcgtccagtcgcgtccggcaggcccggcataacggaagctggacgatccgaaacccagcgccaggcgttcacacaccgacgcatcagaatcgtgcaccaggtctcgtccggtaatgccgaagtccagatctccggaaccgacatagatggcaatgtctttgggccgcagaaagaaaaactcaacgcggttaacggggtcgacaacagtaaggtctttgggatcagtgcgtcgtcgatagccagcctcagcaaggatctcggtagccggctcgcttagcgcacctttgttaggaacggcaacccgcagcatgctcacagcttccgatagacgtcatcgagcgacagtccgcgcgagatcatcagcacctgggtccagtacagcaactggctgatctcttcggccaacacttccttgggttcgtgttcggcagccaaccacacctcgccggcctcctctaggatctttttgcccagcgcatgtatcccaccgtccagggaggccactgtggcactgtcggtaggccgggtacgggcacgttcgctgagttcggcgaacagatcctcgaaggtcttcacggccagcgattgtttcacatgccagccagcaaagtcgcggcggtttcaccggtcgacttgatacgcccccagtcgcgcagcggcaaaaccgcaaacaacgtgccgttgagcatggccaacgccttcccgaggcgggactacctcgcacaccgacgatggatgcctaccccgaggctcggggcacggccatccaaagccaccatactggactaagacaccttgatattagcttagtctaacctcgtatatgttgtggcttgaggacggtaaaccacgaaacgtgacgcctacggtgtaactggcattgtcctcaaagtgcattgagtgctgttgtccactggtgccggtccctgaccacttctggtagaccaaataactgaagctacaacaaaactcgcgccaattctcgtatcctctcctgcaaccaggtgagacggggccgagcgcagagcggttcgtcacggcccatcgaccgttcttttgttcgtggccgaccgcctccgcagtggccattgcggaggcggttggccacgaacttgcctccaccggttacacctccgcatcgaacggcataccgactctcaccgccctcgcagccaaccatgcttagtatacagcactggtcacgacaccaatttctttggcatcaacaccatatcccctcgcattcgacacagccgactacatggagatgcgggttcaggcaacaaccacgatgagcgtctattaagtggtctcaaacgaatgcctggaggcggacgacatcacccgcgccgtaacatcgtcgccaccgacggctcagatagcagtttccccgacccaaccaacaaattaattgttaagttaatcaagaagttactggattttctctgtaacctagccgtcgaattcctgtccggacctctcagcatgatcaccacccagctaccgaacgcactcacctacctggggtccagtcaggtcgccacaatcatcgcttacgcagtattatacaccatgatctatttcggcccgttcgctccgctgctgcttatcgatgcggtcggactaaccgggcttgccggcggttgcgtgctgggcgaagatgcggggccgctgatcgacgtggcacattccaacggccctggccgggcagggcttgcccgcgattagcgtagtcacgtttatcggcaccagccccactgctacatacatcacagccacgacgctgacatcgacgtctctccccccgcatccgggagtaggctctactcaaggcgattacgttgtcaacggtaccgattcgaattcctcacagacaacagacgcatgaccgcatcagcctagggaatagccgagcagagcctcggcaccgaccacggtatcgaactgttcggatttgccgtacccctcacgaattctgctgtcaaccaagctaaaggagtctttctgttgggaaaattccatataggtgaaacttcccaggagccaatgctgcagcacacctgaaaggctgacgagtcgaggtagccctcagacgttgaagtacttagccgccggatggtgcagcacgaacgcatcagtcgattgctcgggatgtaactgcaactcttcagatatcgttacaccgatgcgttcgggttgaagcagctccatcatcttgatccggtcctccaggtccgggcatgctccatacccgaacgcgaagcgggcacctcggtagccgagcttgaaatagtcctcgacggcctcgggatcgtcagccgacatcgtccggtttccggagaatttcagctcttcacgaatgcgccggtgccagtattcggccagcgcctcggttagctgcacaccgatgccatgcacttcaagataatcacgataggaattggacacgaacaactcgccaacgaagtcagcaatgggttgacccatggtcaccagctggaacggcaaaacatccacctcactccgctcggtcgccagatcccgggatcgaataaaatcggcaatgcacaggaaccgaccgcgttgctgacgcgggaaggtgaaccggtaccgctgctcggcgtccggtctcggctcagcgagcacgacaatatcgttgtcttcggacaccgccgggaagtaaccgtacaccacggcggcgtacgccaagacgccgtaggtggacaatcggtctagccagtagcgcaaccgcggccggccctcggtctgcaccaaatcctcgtacgagggccccgcaccgccgcgcacaccacgtaatccccactgacccaagaacaacgcgcgctcgtcgaggaacccggtatagtcggccaccgccagacccttgatgatccgcgaaccccagaacggcggcgccggaacctcgacatcactcggaacatcggagcgttcgggaacctcaactggctcttcggcagccttacgctgcactgcaatgcgtttggaccgctcatgacgtgccttgcgctcagtttccttattgcggtctgcttctgcagctaaggactccgggctccccggcgcagcgcctcgcgcgcttggcgctcataatggtgtccatcaacttcaaaccctcgaaagcgtctcgtgcgtaatgcacttcgccctcatagacttcggccaggtcgttttccacatagctgcgggtcaacgccgcgccgccgagcagcactgggaatttctcagcgactccgcgagtgttcatctcctcgaggttttccttcatgatcacagtcgatttcaccagcaagcccgacatcccgactacgtcggcgcttttgtcctcggccacctcgagaatgttggtaatcggctgcttgatgccgaggtttaccacttcgtagccgttgttgctcagaatgatatcgacgaggtttttgccaatatcgtgcacatctcctttgacggtagccagcacaatccgtcctttggctaaccccttaccgaagtcacagtcggatttctccatgtgcggttctagataagccaccgctgctttcataacctcggccgactgcaacacgaaaggcagctgcatctgcccagagccgaacaattcaccgactgtcttcatgccgtccagcaggttctcgttgatgatcgccaacggcggtttctgggtcattgcctcgtcgagatcaacatctaacccgttgcgctcgccgtcgacgatccgctgtgctaaccggtcgaacaacggcagcttagcgagttctgcctcccgtgtttccttcgacgatggcgacgacacacctttgaataaccacatcagcttctgcaatgggtcgtagccttcgcgacggcggtcatacactagatccagcgcagcctggcgctgttcttcgggtatccggttgatgggcaatatctttgaagcgtgcacaatcgccgaatccagtcctgcttcctgacattcatgtagaaaaacagagttaagaacttggcgtgcagaaggattgagaccgaaggagatgttggacaaccccagcgtagtctgcaccgctgggtgccgcttcttcagctcacgaatcgcgtcgatggtctcaatgccgtctttgcgtgactcctcctggccagtggcaatagtaaaagtcaagcaatcgatgagaatcgccgatttatcaacgccccagttactcgtaatgtcattgataagccgctccgcgacttcgaccttcttctcaacggtgcgggcctgaccctgttcgtcgatggtcagcgcaaccaccgccgctccgtgctcggcgaccagctccatggtcttgacaaaccgtgactcgggaccgtcaccgtcctcgtagttgacggaattgatcacgcagcgcccgcccaggtgctccaaacctgcctgcagcaccggtatttcggtagagtccagcatgatcggcaatgtcgacaccgttgcaagccgaccggccaacgccttcatgtcggccacaccgttgcggccgacgtaatcgacacacagatccagcaggtgtgcgccgccacgggtttggtccttggcgatatctagacacttttgatagtcctcggcgatcattgcctcacgaaaaaccttggagccgttggcattcgtacgctcaccgatcatcagaaccgagggtttttgggcgaatggaatggctgtatacagcgacgataccgacggctcataggtcacatgacgctcaccgcgtggcactgtcccgtcgttgcatctggctaccgctgcggccacttcccggatgtggtccggggtggtaccacagcagccacctaccaacgaaagaccaaattcagcgatgaacccagccaaagcttcggccaattcgtcgggctgcagcgggtattcagctcccttggcacccagcaccggcagcccggcgttgggcatcaccgacaccgggatgcgggcatgcttggacaagtgccgcagatgctcactcatctcagcggggcccgttgcgcagttcaaaccgatcatgtcgacaccgagcggctcgacggcagccagtgcagcgccgatctcacttcccagcagcatcgttccggtcgtctcgacagtcacgtggacgaagaccggaatgtgccgaccggcctgtgtcatcgcgcgccgcgagcccagcaccgcagccttgagctgcagcaagtcctgacaggtttcaaccagtacggcgtcagcgccaccgtccagcatgcctaacgccgactcggtgtaggcgtctcgaacgacccggtactcggtgtggcccagggtgggcaacttggtgcctggtcccatcgaccccagcacgtatcgcttgtggtcgggggtggtcagctcgtcggcgacccgtcgcgcaatcacggtgccccgctgcgacaagtccctgatcttgtcggcgatgtcgtagtcaccaaggttggacaggttgcagccgaaagtgttggtctcgacgaggtccgcacctgcctcgaagtagcgtcggtggatggtttccagcacgtcaggacgcgtttcgttgagaatctcgttgcagccctccaggccgcggaaatcatctaacgtaagttccgcgtcctggagctgagtacccattgcgccgtcacccaccatcacacgctgcgccaaagtctcgaggagatcggtgtcgtactgatgttggttagcggcagttacacgcataaggcataaggatagtggacctatacaaatcgcttagttacctaatactgccccgcagtacctcgtacgtacggtgaagtgccccctcatcgagccgttacacgacacgcatcgtcgtcagccttaaagccgtacgctgattctgtgactttgcgagatggtgggccggatcgtggcgcgctgcccgaactgcacaacaccgttgtcgtggcagcgtttgagggttggaacgatgccagcgatgcggccagcggagccctagagcatctgaatgccgtctgggaagccgatccgattgtggagatcgacgacgaggcctactacgactaccaagtgaatcgcccggtcatccgccaggtcgatggagttactcgggagctggtgtggccagcgatgcggatctcatactgtcgcccaccgggcagtgaccgcaatgtggtgttgatgcacggagtagagccaaacatgcgctggcgcaccttctgcactgagttgctgaccatcgcggacaggctcaacgtcgacactgtcgtgattctcggagcgttgctggccgacaccccgcatactcggccggtgccagtctcgggtgcggcctactcaccggagtcggcgcggcgcttcggtctggaggaaacccgttacgagggccctacagggatcgccggggtgttccaagacgcctgcgtagcggccaggataccggcggtgatgttctgggcagcggtgccccactatgtgtcgcacccacccaacccgaaagcgacagtcgcgctgctgcgccgcgtagaagacgtgctcgacgtcgaagtcccgttagctgatctgccgacgcaagccgaggactgggaacaggcaatcaccgagatagctgccgaggacgatgagctggccgaatacgtgcattcactggagcagcgcggcgacgccgaggtcgatgtaaatgatgcgttgggcaagatcgatggcgacgcgctggcagccgagttcgaacgctatctacgtaggcggcgcccgggattcgggcggtaggcactggctgagaccatggtgtccgcacaatttgccgtcatccgtttgagtaggaaaagatcgctagctaaccctgtcttcacgattcgcggcaagcccaccgaactccggtaggacaacgattaggaccccatgtatggccacactggctgagagccccgaaccaaaatccggcgcgtcgagagctggtgtcctcggcgaggaggctggttaccacaaggggctcaaacctcgacaactgcagatgatcgggatcggcggcgcgatcggtaccgggttgttcctcggcgccggcggccggctggccaaggccgggcccggattgttcctggtgtatgccgtctgcggggtgttcgtcttcctgatactgcgcgcactgggcgagctggtgctgcatcgtccttcatcgggatccttcgtgtcttacgcacgtgagttcttcggcgagaaagccgcctacgtcgtcggctggttgtacttcctggactgggcgatgacagcgatcgtggacaccactgccatcgccacctacctgcatcgctggacaatcttcacggcgttgccacaatggactcttgcgctgctcgccctggcggtggtgttggtaatgaacctgatctccgtggaatggttcggcgagctcgaattttgggccgcgctgatcaaggtttgcgcgctgatggcatttttggtcgtaggaactatcttcctcggcgggcgttacccggtcgacgggcacaacactgggttaagcctctggactagtcacggcggattgttccccaccggcgtagcgccagctaatagttgtcagctccggagtgatgttcgcctacgctgccgtcgaactggtcggcaccgcagcaggtgaaaccgtcgagccgaaaaaaatcatgccgcgagcgatcaactcggtaatcgctcgcatcgcgatcttctacgtcggatcggtgattctgctggcattgttgctgccctacagcgcattcaaggccagcgaaagcccgttcgtcacgttcttctccaaggttgggttctacggcgccggcgatctgatgaacatcgtagtgctcaccgccgcgctgtccagcctcaacgccggactgtacgcaaccggccgtgtcatgcactcgatcgcgataaatggtagcggaccgaagttcaccgcgcgaatgtcgaaaaatggtgtgccatatggcggaattcttttagccgccgtcatctgcctgtgcggtgtcgcactaaacgccttcaaccccggtcaagccttcgagatcgtgctcagcgtcgccgcactgggcatcatcgccgggtggggaacaatcgtactgtgccagcttcgactacacaagatggccaaagccgggatcatgcgccgaccccgctttcgcatgccgctggccccatacagtggctacctcactttggccttcttgttcgcggtactggttgtgatggcgttcgacaaaccgatcggcacctggacagtagcgtcactgatcgttatcgtcccagccttgattgcaggctggtactcaatacgcaagcgcgtgatgaccatcgcccgtgaaagaatgggctataccggacctttcccggcgatcgccaacccaccggtgcaaccatcagaacgatcccatagccagaatccgtagatcaacacagttactaggcctattgcggtcgagttcccctaacctaagaaatcagtacaacctcacgaccaaattgcacactaaccctgtcttcacgattcgcggcaagcccaccgaactccggtaggacaacgattaggaccccatgtatggccacactggctgagagccccgaaccaaaatccggcgcgtcgagagctggtgtcctcggcgaggaggctggttaccacaaggggctcaaacctcgacaactgcagatgatcgggatcggcggcgcgatcggtaccgggttgttcctcggcgccggcggccggctggccaaggccgggcccggattgttcctggtgtatgccgtctgcggggtgttcgtcttcctgatactgcgcgcactgggcgagctggtgctgcatcgtccttcatcgggatccttcgtgtcttacgcacgtgagttcttcggcgagaaagccgcctacgtcgtcggctggttgtacttcctggactgggcgatgacagcgatcgtggacaccactgccatcgccacctacctgcatcgctggacaatcttcacggcgttgccacaatggactcttgcgctgctcgccctggcggtggtgttggtaatgaacctgatctccgtggaatggttcggcgagctcgaattttgggccgcgctgatcaaggtttgcgcgctgatggcatttttggtcgtaggaactatcttcctcggcgggcgttacccggtcgacgggcacaacactgggttaagcctctggactagtcacggcggattgttccccaccggcgtagcgcagctaatagttgtcagctccggagtgatgttcgcctacgctgccgtcgaactggtcggcaccgcagcaggtgaaaccgtcgagccgaaaaaaatcatgccgcgagcgatcaactcggtaatcgctcgcatcgcgatcttctacgtcggatcggtgattctgctggcattgttgctgccctacagcgcattcaaggccagcgaaagcccgttcgtcacgttcttctccaaggttgggttctacggcgccggcgatctgatgaacatcgtagtgctcaccgccgcgctgtccagcctcaacgccggactgtacgcaaccggccgtgtcatgcactcgatcgcgataaatggtagcggaccgaagttcaccgcgcgaatgtcgaaaaatggtgtgccatatggcggaattcttttagccgccgtcatctgcctgtgcggtgtcgcactaaacgccttcaaccccggtcaagccttcgagatcgtgctcagcgtcgccgcactgggcatcatcgccgggtggggaacaatcgtactgtgccagcttcgactacacaagatggccaaagccgggatcatgcgccgaccccgctttcgcatgccgctggccccatacagtggctacctcactttggccttcttgttcgcggtactggttgtgatggcgttcgacaaaccgatcggcacctggacagtagcgtcactgatcgttatcgtcccagccttgattgcaggctggtactcaatacgcaagcgcgtgatgaccatcgcccgtgaaagaatgggctataccggacctttcccggcgatcgccaacccaccggtgaaatcctcagactgacgactgactctcgcacgagttggattgatcgtccgcaaccgatacgccagtcagtcaccactgtacggaatggccatgatcttctgaaccatcactatcgtcgtggttaccgcatactggcacgccagctggtggtcactgattggttatgccgcggctgcgctcacctcggttatcggggtccgcgctcgctttccgcgccccttcctgacaaccgttcgagccccggaacgggcacctttaggatttcgctaagtcctccagttgtatgcgctaaggtggagcgaccgagcgcgacaatctcggcatccatgtacaacaccagatcagcagaaatttttcggacgggcagtatctacctatccgagtgggtaaaaccggtttgatccagccgaacaaacccccaacccgggtcatacacgtggtccttccggcctccggtgccctagaacaaacgccgtagcgcaccaatccaccgtgctggtcttgtggaacggaacggtcagggtagtgctgcaagcagttagccaaatgccgggtaggtcgtcctcggtgtcgcgaaccagcggggtatcgatctacgacatgtgggcccgtatctacgccgacactgagcggaccaatctccattcgcacagagttggcgaaatgtcattgcctgccttttgacacattgtaaggcatcatccccgatggcattcgtgaaggcggccatcgacgagattatcagcagataacttcagcggtcgatcaacaccgacaatgtggcacgcaccgtgtataaaaacaccaaataaattaacatctaacactcactggaacaccaccgggtcgacccacaggacaaaaccgtagctagctatacccgcgttggctaccaccacgtcaataccgccggaacgtttatgacctgctcggatgtggcttgcaaggcgcacggatctcgcacctcagcaaccacggtaaactagctactagactttgtccagatcgatcagtgcaagtttggcgcctttataccgtgtagccgacaagccagctgtgcgccgattcacctgggcaccacccgtgatgaacatgactttgccgtgcaacgatgtcgtggccgaaaaccgcactttgcctctgcgaccattacaggtccacccccagcaacgcatcgatcgcggttgccagcaactttggcgccgccgcatcgtggcctccgtactccagcgcatcggttacccaaccatccaatgcagcaatcgctttaggagtgtcaagatcgtcagccaaatacccgcgcacccgggcaataacgtcagcgacgtccggaccggcgggcatcgaggcagcggtgcgccagcgatgcaaccgggcgatagcatcgtctagcagctgcgaactccaaaacctgtcagcacgataatgcccggctagcagacccagccggatagccgagggcgggcgccttgaggccgcagcgtcgacaccagcaccaggttgccgcggctcttagacatcttgtgttcgtcccagccgatcatcccagcgtgcacgtagtgccggcgaatcgccgttcacctctgacgcattcagcatgcgccgcggtgaactcgtgatgcggaaagatcaggtcgctgcccccgccctgaatgtccaggccgatgccgatacggctgagcgcaattgccgcgcattcgacgtgccagcccggccgtcccggaccgaacggtgacgaccaactgggctcgccgggtcgtgcagcccgccacagcaatgcgtcaagctcgccgttttttccaggccggcgcggatcaccgccgctttgctcgtacaatcgtagcatggtgtctcggtcatagcctgactcgtagccgaactgcagcgttgcatcagctcggaagtaaatgtccgggtactcgtcgtcgatgacatacgcggcccccgaaaccagcatcttgtcgactagttcgacgatctcgacaatcgtttcagtcgccgccacgtagtcatgcggcggcagtatccgcaacgatgccatatcatcgcggaacagcgcgacctcgcgttcggcgaggtcgcgccaatcgaccccgttacgatcagcgcgttcaaacaacggatcgtcaacatcggtgacgttctgcacataatgcacctcgtgacccaagtccagccatagtcggtggatcaggtcgaatgccaaataggttgcggcgtggcccagatgagtggcgtcatacggagtgatcccgcagacgtacatggtcgccttgcaagtgggcgcaacagcagcggacaccggacgtacctgtcgatcagaggtgtcgtacagcctgagctccgggccgcggccggcaacgccggaacctgtgcgaaagaccacgacagcatgtcgttgactttaagccaagcatccaacgaaattgccacgatgatcgtggttcccacccacaccacagccctcatggcaatcttggcgcacgcgaaggcggttcattgccacacctcacggatgacaccgagcagtatcggcgcgatatcggcgcgacacataacaaagtcgggtagatacggatcgagctggttgtaacgcagcggcgagccgtccaggcgcgatgcgtgcataccggctgccaacaccaccccggctggcgctgccgaatcccattcccattggcccccgacatgcaggtaggcgtccacatcgccgtcgacaaccgccatcgctttagcccccgccgacccgatagccaccggttcgatggccaacttttgccgtatccggtgcaagattgtgggcggccgggtggcgctgacagcaatccggagaatgttgggaacaccaccagtcacagcgccggcggtcacggtgtcactgcggtacaccctgttaccgcgggccggcagcgccaccgccgcatcagtgatctcgcgccggccgtctgcgacgccgccggtggtacgttgccacagcgctatatgtaccgcccagtcagtgcgccccgctgtggagaattcgcgggtaccatccagtgggtcgatgatccatacccggccagcctgcagccgaacacgatcatcatgtgcttcctcgctgagtaccgcatcacccgggcgctcggcccgcagccggctcagcagcagggaatttgccagcctgtcaccagcatcgccgagcgcccgcggttggtcgaaaccgatctcctcgcgaatttcgaggagtaactcccccgctgccgtggcgagatcggcagccagtgcagcatccgttaactctgcctggtaatcccttttgtcatgggaggccatgttcaccgcttcagtatcgccgagggcacagctagtccttaaaatgccggccatggaatggcacgatcccggttcggtccgggcatcaccgggttgtctaacatcgcgtacgcacgcctacgcaaagcgatgatttctgcccaggtaatctgcccggcaagcgtatcggccaacgggccgctaagggcgtcagccaacccggcgacctcctctagggtttggttatcgatcggcttaccggcccaaccccataacactgtgcgcaatttgtcttcgacatgcagagacacaccatggtcaaccccgtacacgtggccgtcgaggccgtaaaggatgtgaccacccttacgatcggcgttgttgatcaacacgtcgaatactgccagtcgccgcaactgggtgtcgtcggcgtgcatcaagatgacctcgtcgccggcatagttgtaggaccgcaacaccggcagataccccgactgcagcttgtcggcgggaaataagtcaaccatgtcgggcccggaccggggagcggagtcggcaacgtcaccgggctgttgcacccacagctgcagcatgccaggacctgccggcccgtcacgaattaccgtatagggaacaatattccaccccaagtcagtcgaaaccaggtatgcactcagttcgcggccagctaaagttccttccggaaaatcccacagcggctgctcaccggaaaccggcttgtagacgcaatgcacgctgcgctggtccagcgtggattcgcacaaaaaagtggcattgctggccgaacggatgcgtccacggaccgtcagttcgccgttccgcaacacctcatgctcatcaccattcggtgtcatcatctttaggcccgagcaacgcgctgcgcttatagccgttggtgcgcgcacagacgtgcccctcagggtccaacggttcgtcgcacagtgggcacggtggacgtcccgccaagatgacacggttagagcgagtggcgaactgtcgtgccgactccggcgtcaggaacacccgcaccgcgtcgggaccctcatcggtgtcatcgagcaccacggaggcgtcgaactcagcgtcagtaacggccagcaactccaccaccacggtctgcgcttccgaatcccagcctaggcccatggtgccgacccggaactcggcgtccaccggcataaccagtgggttaaggtcattgatctcagcgggctccgggggcaccggggtgccgaacctgcgatgcacctcgaggagcaacgcaccgatgcgttctgcaagcaccgcaacctgctgcttttccaaaaccactgacaccacccgagagtcgtgcaccgcttggatgtaaaaggtgcgattcccgggctggccaacagtcccggccacgaagcggtcgggtgtgcggaagacgtgaattgcgcgggccatggcatctccaaaataccggcagttgggcccaaggtgtgatccggacgcgggcgcaaaccgaaccggctccgaaagaactagtcggcggagccgccgagtaccgcatcaccagacggcaccgcagcatccggttcgttccgtatctctcctgagcgctcgccacaagaatcactgtgggactcacctgaaggcttcatcgcggcccgcaacgccgacgacaactgcgcaccagtgtggttgacgtgcagcacaaacggccgcagctgagtgtagcggatcacactcactgatcccgggtcggcgatgacacgttgaaagctatccagatgcatgccgaacgcgtcggcgatcaccgccttaatgacgtcaccgtgagtacaggcgacccaaagcgtgtcaccaccgtgttctgaagtgaatcgccggtcgtattcacggatcgcggccaccgcgcgcacctgcacctgagccaacccctccccgctgggaaacaccgcggcgctgggatgtgcctgaactacctgccataacggctccttggccaagtcaccgatgctgcgacttgtccattctccgtaatccacttcggacaaccggtcatcgatgaacggctcaaggcacagcgtttcggcgagcggattgatggtacgtcgacaccgtagtagtggcgagcataccaccgcccgaatcggtaattcagcgatccggtctatcagaccgacggcttgctcgcggcccctgtcgtcgaggtcgaccccatcggcccgaccagctaaaacacctgcggtattcgatgtggaccgcccgtgccgcaacaaaatgaccgtcatgtcgcagctaccgtcttgaccgccagcaggatcagtacacccacgccgacgactatccggtagccgacgaaccagtacaggttgtgctgcaccagaaaccgcagcaaccaggacaccgcaaccaaaccgacgacaaatgcgatcacagtggccaccagcagctgcgcgccggtggcactcataccctcagtgataggatggaaggcgtccggtatcgagaacaacccggacgcgaacacagcgggtatggccaggaggaagccgaatcgggcggccaattcacgatctagtccgagaaacagcccagcgctgatagtcgagccggatcgtgagacaccaggaatcaacgcaagcgtttgggccactcctaccaccagagcgtcacgccagttcagctgctcgatacaacgattctgacgcccgacatactcagcgaaggcgattacccccgaaaacgccaccaacgcggtcgctacgacccacagaggacgaattcccgggcggatctcgtccttgcacaccaggcccaggatgcagattgggatggtcccgatgatcacataccagcccaaccaatagtcgcggtgcggtgcaacgtgacggtcaggcctctacaccaggcatggagaatgcgtacgatgtcgcgtccgaagtacaccagcaccgcgacctcagtgcccagttggctgaccgcggtgaatgaggcgccagcatcgccagtgaacaagatccgcgacacaatcgccaggtgacccgaggatgacaccggcaggaactccgtgagaccttgcaccacggccaaaacgatgacttgccaccaggacatcgccgaaaccgcagtcacgacgacgaccgtacctggtggcagccggtacctgatgcgactaacctgagaccgttaacgtgcgtgcgaccaaatctcgcaccgccgcagccaggctgcgttcgtcggtgaggtcgatgttgaccagcccgcggatcgccctcgggactacttcttcagtctgcggaacaagcccggccaatcgtgtccggtaaatttctacgactaacgaccagtgctcgatgtggaatgaaaaactgcgtccatcaccgacttgtccatacccgctggcgaaaattcccgtcgaaatctcctcgacggtaaactcgttgcctgccacatgccggtcaacggtgacagtcatactgtcaagatacctcatcccgaaccggtacatattgtagcatcccagattgaatacaatgatgcaccatcgttccttagaattcgagtttgatgtatagtattttagggttagccgttgctgtcgccggataagcgaacagttcaacactgtttagctggcgtgttgctagcactcatgaccggatgttcgtcggatcggcttgatagctccccacccactatcgaacccgcgcagccggccgactcaccgccggtgtcacagaaacctgtgggtgtagtgcgaccactgggcggccacccgcagggtgtgatattcgacagcggcagtcacctgttggcggtcctgtgcccaggcaccgatcccgctgcgcccgccagcgttaccgttttcgatgacgcacacactcagccacgcgtgatcgttctaccggggcctgcaaccgcgttgaccagcgacgaccacggcaccgcctatcttgcctcgcacggtggctacttcgtggtcgatctcgaaggcggccatacctcacaagtgaacgtaaccgacgctggacacgccaaattcaccgcaatcgcacgccgagcggacgccaagttggttctgggcagcgccgacggcaccgtctacactcttgccgcgacggcacctggaaccaacaccgctaccgctagcaaccgaaacaagatctttgctcgtatcgattccctcgcaacccaaagaaataacacggtagtgctggatagtggacagacgtcaataacgacaataggagccgacggtcatgtccagcaagcgctgcgagccggcgaaggcgcaaccacgctggccgctgatccgctgggccgtattttagtcgccgacacccgcagtggccagctattggtgtatactattgacccgctaatcttgcgccagacctatcctgtgcgccacgccccgtacgggctagccggatcccgcacgttggcctgggtatctcaaaccgcctctaacatcgttattggttacgatctaaccaccggaatccctgtcgaaaaggtaagttatccaaccgtgcagcaacccaattcgttggcttttgacgaagcgtcagacaccttgtatgtggtatcggagtcgggcgcgggagtgcagatcatcgaacacgcagtaggtacacgttgagcaaccgactggcgccaccgcggagccggctacccgccggttgggacgctgagatgtctaacgagtacgaatgggtgccgttgcacctgccgtcagaattgaccacgcttaacgcatcgacccggctgtccatcgaggctgaatattgcggttgggagctgatcaaggtgcggatctacaccgacggcagtaggaggacattgttgcgccgcaataactctcgtctagaaaacacaggctccgaccggtgacctggctagccggaactgtgatgtaccgggtcgtacgccggctgctgttcctgaccccacccgagcggatacacacactggtttttgccatgctgcgttgcgtaacctccatcgctgtgctgcgccggttgctgcgcgggtactgggaccgacggatccggtgctggccagcacggtttttggggtccgcttccccggaccgctggggctggcagcgggcttcgacaaggacggcatggggctgcttgcctggggtgcattagggttcggttatgctgaagtcggaaccgtcaccgcgtacccacagcccggcaacccggccccgcgcatgttccggctgcccgccgaccgcgctctgctgaacaggatggggttcaacaataacggcgccggagcgctggctatccagctcgcccaccaccgccccgaagtgcctatcggggtgaacatcagcaagactaaggcaaccccggcctcccatactgtcgatgactaccgggccagcgcccggctggtcggcccgctggcctcgtatctggttgtcaatgtcagctccccgaataccccggggcttcgcgacctacaagcagtcgagtcgcttcgggccatcttgttgggagtcctggctgagacctcagtaccagtgctggtcaagattgcacccgatatctccgattccgagatcgacgacatcacagacctagccgtcgaacttaggctagcaggcatcgtggcaaccaacaccacagtatcgcgtgactgcttggtgacaccgggaatcgatgcgctgggggcaggtggcatctcggggccgccggtggcgcgccgcgctgtcgaggtgttgcgccggctctacggacgggtcggtgaccgtctggtgctcatcagcgtgggaggcatcgaaactgccgacgacgcatgggatcgcatcacagcgggcgcctcgctgctccagggctataccggattcatctacggcgggggattctggcccaaacacattcacgacggcatcgcacgccggcttcatgacggcgggttcgcctcactgcgcgacgcggtcgggtcggcgaccgccaaatcggagtgaccgccaggatagataatgccaccgtatcctggtcatctgtagcttcgtcgcatagcagcttctcggggcgatgaaatccgcaggacaaagtcagcttgtcgatgttggtgtggcgcgtggtctcccaatcctggatgtgtgcactcgcatcaacgccgagaacatcgcggtctgggcgtgtgcaaccgcgattccttagcaaaaattgcgataatgcactgcgagtaactaaggtgacaagtagcagtgtggcatccgccactcgtcacattcctccggggaccattgccagcgtaaacgtgatgctatcgccggtggctataccccctgtctatcacatccgatttgtcgacgttccggccttcgtcagctggaatcccccattcggaatcgcgtgctatgacctcgccgtcgcgttaacgttctacctgttgaatatacgaatcccgctaagacgagatcagtgcaatacctatcgacatcctgatgctctagtgggtcttgttgtcacgcaaggtaatcaacttatgatagcactcaatataaaattacgttaatcgaaccgcacaatcgcaaaaaatttagaacaacaccgaatatatgtgcaagaatatctatccaaatatccaagtctagagctcattaatcggcacgaaaataataggctgaagcacaatttccactttgattatggactaaagtgaatcccactcaattcttgaatgagctaattctcatttttttagctcttgcgggaccgatctgaattgacttttatcaactttctagccccatgaccactgccgagtttctagttgacatgtact

SEQ ID NO: 127 - DNA (genomic), 35881 bp, MYCOBACTERIUM LEPRAE; double-stranded, circular
  hypothetical: NO
  anti-sense: NO
tggagggaactgcattgagccactactttgctaaagtccgtgatctcgcgttcaacctgtttcgaggtcctttatctagcagccgtcctcggcactagacgttacgacgatatcgacgttgacacagtgcgaacaatattgaccgaagccgctcgcttggcggaagaactggttgctgagtcttttggctacgcagaacgcaacccaccggtgttcgaccccgcgatccacaccatcagcatgctcgccgaattggtcaagtcggtccaagccatcaaagaagctgagtaggcctcctgggtctgaccgaggagatcggtggcagggccacacagccgccgttgacctgggttgccaacgcaatgatcttctgcgctaatccctcagcgtactcttcaatttggtcccggtgatggccaaggcgctctacatcgaaggcaacaaacaagcagcgacgggggtgtctagcgctaatggcctgacgagcccggcctaggccaaggccgtcgaataacccgacgacacctggcacatcgaggaggtcaagcgattcgtctctggaggagacggcgccagtaccgccgaacatcttccatttagtgcctgcctggctcgaggacgttagtccgggtactaaaggggtaagcttgttcatatatccccaaaaaccttttagatcccgaagccttcgaattcggtccctacaacggcgtttttgttatcgtgcgatatggcttaagtcctcccccacgtacgagctgctttcggcgccactgacgtacccgccgttggctatctgaccggtggcgtgcacaacgggatcgcacagatagtcgccaatcattgaagtacactcgcatgacgatcggcgttaagtcgaccggcatgctgtccaccggctacctgaacccgcttgtctacgcgcagaaacaagtccaaggcgcagatttgacccaaatgacctaataagaccacaccacaggtcacgatcatgcaccaccctgatgtgtgccgcagtcttatgcccaagaaggcctacgtcgaggacatacgggccttaatctttatgccacagcacaccagggtgtctatgatagtacaacaagttttgtgcgcagatcccaacggggtacaccaccgtgaccacggtcaagcattacaacacataacagctcggaccagtcacaccatcgaaaactgcaataaatcaatgaaaaccgatgccaagctgcttgtgactgcgctcgacgacatcacggcgatgacgggtgcgctgaccagaatacctcatgtccaccgcgcaacacctcacctatattcacgaggtggggctcgaatcagtgcgttacctgccggccgccgacgatctgttgatcgaatgacgattactggtacaagtctataattgcacgcaccacactagccaacatcgcgacacgcaaagacacaaaaactgattcagcgttctatcaatgcaaaatcacggccgcaacgttcctcgccaaggacatgttgccgagattgaccgcactgcgcggcatcatcgaatccatcgatgatgagatcatgctcgtctccgacgaaaacgttctgaccgatcacgcacaacttatatacaccccacttgtagtggcactcgccgatcctgaagtcaccgggaacccgcagggaaggaagaaggttgatacctttagttttcagacggtaaagccgagagcgcgcagttgttcacgcccgtcatcgctgattttgtccgggccccacggcgggttccaaacccaattgatccgcaggtcgctgaccagaccactgccgaccaacgcgctgcgtgactgctcttcgataacgtcgttcagtggacaggctgccgacgtcaacgtcatgtcaaccaaggcgatcattccttctttgccctcttcaagacccaagccatagaccagtccgagatcgacgacgttgatccccaattctgggtcgacgacgtcacgcatagcctcttcaacgtcggcaagcaactcgtcacccgacgcggtgattttgctcatccatgacctcctcgaggactttatctgccgaattagcatgtatcaaagcatctttgcaagccatccagccaagtaacgcgcatttgacacgggccgggtacttggctactccggcgaacgctaccccatcacccaggacgtcctcgtcaccctcaatcgttccgcgcgaggacaccatctcggtgaacgcggagatgatgttcagtgcgtcaggaacactctgaccgatcacctgctgagcaagcaccgagatcgacgcctggctgatcgaacaaccttgtccttcatacgaaatatctgcgacactagcaccgttgtcggataatgccacgcgcaaggtgatctcgtcaccgcagatcgggttgacgtggtacacttgagcacagaacggctcacgtagcccgcgatgctgggggtgtttatagtgatcgaggatcacttcctgatagatctgttctagacgcaatatcattctctcccaaagaaatccaaagctcgtaacacacctgccaccaagcggtcgacttcatcgacggtgttgtacacggcaaacgacgcccgcgcagtggccgctaaagcaaaccggcgatgcagcggcaacgcacagtggtgcccgacccgcacggcgacgccgtcgtcgtctaacacctgaccgatatcgtgcgcgtgcacgccgtcgacgacgaacgacactggcgagccgcggttctccatcgacttcggcccgattatgcgtacaccatcgattctggacagaccctcaaccgccgctgctaccaactcgcgttcgtgggcttcgacggctttcatcccgatggcgtcgagatagcgtgcggctgcggctaatccaaccacctgggaagtcatcggggtaccggcttcaaaccgctgcggcgccggagcatacgtcgtactttccatagtaaccgtctcgatcatcgaaccgccggtaagaaatggaggcatcaccgataacagctcacgccgcgcatatagaacacctatcccgttggggcccaacattttatgtccggagaacgctgcgaagtcaacacccaaaccatgcaaatcgaccggctggtgcggcaccgactgacaggcgtccagaactgttagtgcacccacctccttggctctcgctaccagctcacgcacaggagccaccgcaccagtcacattggagtgatggctgaaagcgacgaccttgacgcgctcgtcgagctgtagcgagtccaagtcgatttgcccgtcgtcggtgactccgtaccagcgtaacgtcgcaccaatacgccgggctagctcctgccatggaatcaggttagcgtggtgctcgagctcggtagtgacaataacatcaccaccgtcaccggacgtaccctcgaaccgattgtcgccgaagacatatgacactaaattgagcgactcggtagcgttcttagtgaagaccaattcgtcggcggcagcaccgataaatgccgctatgtcgacgcgcccccgctcgtaggcgtcagtggcctcttccatcaattggtgcgcaccacgatgcaccgcaccgttggacgtaacaagaaactcccgctcagcgtcgagtacctgaaccgggcgctgcgacgtcgccccagaatccagatatgctaactggtttccaccccgcatgacgcgctttaggatcggaaaatccgcacgaatcgccgagagatccaatggggtcagcgagatagtcatacttagactccggttgccgccggttgggagaaacgtacgtagccgttctgctcaagttcgtcggccagctccgagccaccagattcgacgatccggccgccgacaaacacgtgtacgaattccggacgaatgtagcgcaggatgcgcgtatagtgggtgatcaacaaaatgccgccgtgctccgaatcagcgtagcggttcaccccatcgctaaccacacgcaacgcgtcgacatccaacccggaatcggtctcgtctaagatggcgattttaggcttgagcagttccagttgcaggatctcatggcgcttcttttcgccaccggagaagccctcgttgacactgcgttcggcgaaaaccggatcgatctccagcgcacccatcgcggctttcacctctttgacccagtgccgtagtttaggcggttcgccgcgaatgacggtcgcggccgagcgcagaaagttcgacaccgatactccaggaacctcaacgggatactgcatggctagaaacaacccggctcgcgcgcgctcgtcaacgctcatcgttagcacgtccgcgccgtctagtgtgatggcacccgagataacccggtacttgggatggcccatgatagcataagacaacgtggacttgccggatccgttggggcccatcaacgcatgcgtttccccagatttcacggtcaggtcgacgccattgaggatggggatctggcactcggattcagcggcgttgggatgctcaacgcttacgtacaagtctttgactatcaaagtcgtcatgaggctgttgatctcgattccgtgatggtcagttcgtgttcgatagctgcgatcagccgctcccgcacctggggcaccgcgatcttggagataatttcgccgaaaaagccgcggaccagcagccggcgggcttgctcttcaccaatgccacgggaacgcagataaaacagctgttcatcgtcaaaacgtccggtagcgctggcatgtccggcaccaacaatttcatcagtctcaatctccaagttgggcaccgagtcggcacgcacaccgttggtgagcaccagattacggttcacctcgaaggtgtcggtgccagtcgcctcggggtgaatcaacacgtccccgacccaaacggtatgagcatctggccgtgacgagaccggatctccttgcagtgcacctttgtacagcacattcgatttgcagtcgggatgagcgtgatcgaccagcagccgggactcgaggtgctgcccgtcgtcggcgaagtacaaacccagcagctcggcatcgccaccgggcccggagaaccgtacattggccgacacccggacgacctcgccacccagtgtgacagtgatatgccgcagcaccgcatctttgcccagcagggcatgatgtgcgctgagatgaaccatatcgtcggcccagtcagcaatccacaccacggtgagccgtgcggcggcctcgacaatgaactcgacgttgtcggcgtaagttccactcccccggtggtcaatgaccacgacagcttcgccaaatttgcagaccctgatctgtagatgaccgtacaccactgcgcctttgtcgggcccggttacggcgatgttgatcggggtagcgatctgcatatcccgcccgacagtgaccaccgtcgcggactggaacgacgaaaatgcctgggctgcaacacgatcagtggggatgccgccctgccccagccgtccgtcgccacggcccacgatctcggtctgcacaccagactgctggctgactctaatatgcaccttgccattggccacggccgagccgtcgtgtaggccgcgcaacctccgcagcggcgtaaaccgccaaatctcgtcacggccaccgggcacttcgaaagcgtcgacatcaaacgacgcgaacaacctccccttattcaatgctgtaagtgaagatccttcaacagcggtcatccgaccgcaccctccatctgcaattcgatcaatcggttgagttccagcgcgtactccatcggtagctccttggctatcggctcgacgaagccgcgcaccaccatcgccattgcctcatcctcggccaacccacggctcatcaagtagaacaactggttctcgctgaccttcgagacggtggcctcatggcccatcgtgacgtcgtcttcgcggatatcgacgtacggatacgtgtcactgcggctgatcgtatcaaccagcagcgcatcgcattttacgctggagcgcgacccgtgtgcacctttattaacctgcaccagaccacggtaggaggtgcggcccccacctcgggccaccgacttggacacaatattactcgacgtgttcgacgccaggtgcagcatcttggccccggtatcctggtgctggccttcaccagcgaacgccactgacaacacctcacctttggcgtgttcaccggtcatccaaaccgccgggtacttcatggtgaccttagacccgatgttgccgtcgatccactccatggtggcacccgtttcaacacgggcgcgcttggtgactaagttgtagacgttgttcgaccagttctggatggtcgtatagcgaacgcgagcatgcggtttcacgatgatttcgaccaccgcggagtgcagcgagtccgacttgtagattggtgcggtacaaccctcaacgtaatgcacgtacgagcccgtatcggcgatgatcaacgtccgctcgaactgacccatgttctcggtattgatccggaaataggcttgcagcgggatatcaacgtgcacacccggcgggacataaatgaagctgttgtgcgccacgatcccgtttgcaacgaaattctccaaacccacaacctggatgtcgtaggtgggcttctcgcccaccagcgtcttactcttcaaacgtgcgaagccgacggtatcggtggacaatgacgagaaattaagcccagcggcagcaacataccgctgtcttctccccttgttgctcaccggtttccctcgcttgccaggtgtacgagtacctactcggtcgagactgccctgaatccgcaaccgccaactcgtgctcgtgacgatgcgaccgtccctgcaggttgcactccgtgttcgctcaacgagccgcccgtcggggtatagcccgcaaccgatagcaagttgcctgacgtcttcgagcagctcccggctggcaaacgcgatcgacatggtggcaccactgctctcggtccaaccatcagcatcgaccagtccgccaataagcgcgagctggtgctcatgcggcaagctataaatccaggcaggcagccgcttggttttctcgtctccggaaaatccaagttctgcaagccatgtctcgaaagccttggaactcacgatgaatccacaattcaccactgtgacgttggcaccgaactgttcactcaccacccggatggcagtgtgatgcactggatcacctgcagggaccgagaacgcgacttgccgcatgtgcttatgcggtgcagcggtatgaccatcacctagccacaatcccaagagccaaagcagatcaacgctgttctggcatggaaaatagagacactgccgggttcggttcttgatgtccagttccgactcggagaagaaaatggttccgctatcgtcgggcaacacgcgagcgaccgcgatcggctcacccgactcaatctcctcgagtggtgcccaaacggccgtccaccgtgtgcgcttaccctcctcgactctccttgccactaagaattgatggtttccggttgcttcgagggcccgacctgcaacgtgcatctcgtatacgggcttggtgccgcttgccaccttagccaacactttgccacgctcgagttcgcatccaatatttacaccaaacacttcatcaccgggctggacatcggcaatactcaccaagcccttgcccttgacattaatacgagcatcggcggttagacacccgccactccacactgccgtattcaatgcggaaaacttattatcgcccgccgggatcacagtgcctaagtactgcttgaagatgtcagggtattcccgcaaacccgtttctgtgtcgaggaagacgacaccttgatccttcaagtccgctctgatttggtggtaaactacctctgactcgtattgcgccgctacgccggcaacgagacgctgcttttccgcgtccgggattcctagccggtcgtaggtgttgcggatgtcttctggcagctcatcccagctggcggcctgcttctcggtagagcgcacgaagtacttgatgttgtcgaaatcgatcccatcgagattggaaccccagcgcggcatgggcttacgctcaaagacacgcaacgcctttagcctggcctgcagcatccattccggctcatcctttttcgctgatatgtcccgaacaacatcttcggagagcccgcgccgcgcgctggcgcccgcgacgtcggaatccgcccacccgtaaccgtatttacccagcgagtcgattgcctgctgctgggtcaacaactcgggagccggcgacttcgtagtctctgacgtgcgtgtcatctgagcgctcctttggtgctcgttgtgtggcgcggcctgagtgccgcactgctaggtcttgcttggtaccgacatgagtggcacgtgggtagtacaggcacaatctccgttgacgatcatcgccaaccgctgcacgtgggttccgagcacctcggcaatggcctgctgctcggtttcacacaactcggggaattcctcggcgacatgggacactggacaatgatgctggcagatctccactccgtggatcggtccgcccacccgcgcggtggttgcgacgtaaccggcgtcactcagcgcactggcaacccggttggcggctgcctcaacgtcggctccgccaccggctggctcaacatcggccaagatcgcgtcgatacgttgtcgagcgaacgtgcgaacagcgtcctccccgccgatttcccgcagttgtcgcatagcagccgacgccaaggtgtcgtaagcatgaccgagcttggcccggcccaccgcggtcagccgatagtgcttggcggggcggccgcggccaacctgctgccagggcgccgcagtcgcggactcagcgtcgcccatctcgatgagcacatcgagatgacgtcgcacgcctgcggccgacagacccagacggtcgctgatttcaccggcggtgatcgacccggactccagcaacaagcgcaccaccgcgcggcgagtgtgaccatccgacactgcgactgtcgtagcagcatccagctccgaccggattttcacaacaccagtgtgacgcaattctggcgatcggtctagggaagggtaccctcggtgaacgttgagcacatcacatcctgaaccttgccccagcgccggctggcatgctgctaagcctgataaccccgtcccgcaacggctcgcgttccgggactcgcctcgtcgttagggctacgctcctctgatggcagcccgccaccacacactgagctcatccatcgccagcttgcatggtgatgagcaggcagtgggctcaccactgaacgatgccgaccgtggcgcactacagcgcacccgcttgtttggggctaccggcaccatcctgatggcgattggcgcgctcggagcaggggccaggcccgtcatccaggaccccacgttcggggttcggctgctcaatctgccgtcaagaatccagacggtctcgttgacgatgactacaaccggggcggtcatgatgacgctggcctggttgatgctcggccggttcgcgctgggcaggagacagatgtcgcgcggcgagctggaccgcaccctgttgctgtggacgctgccgctattgattgcaccaccgatgtacagcaaggatgtctactcctacctcgcgcaaagccagatctccctacagggactcgacccttaccgggtaggtccggcgtccgcactgggactaggccaggtgttcacgctttcggtacccagcctatggcgggaaacacccgcaccctacggcccactgtttttgtggatcgggcgcggaatctcagcactgaccggagacaacatcgtcgccgcggtactctgccaccggttgatgatgttaatcggcgtcggcctggtcgtgtgggcaaccccgcaactggcccgacgctgcggcgtggtcgaggttagcgcgttatggctaggtgcagccaacccactgctaatcatgcatctagtcgccggcatccacaacgaggcaccgatgctagggcttatgctcacaggggccgaattcgctctgcgtggcattgacttctcgtccacaacacgagtgatacccacctcctggcgcggtggaggtaccggcaggcaacacagcggcacgcttacaagccaggcaatccggttcggctcgaattgggagccgctgggcatgttgctggccggttcgatcctgatcgtactgtcttcacaagtgaagctgccgtcgctgctggcactgggattcgtcgcgatggcgctagcctgccgacttggcagtaccccgcaagcactgctaatggtcagcttgtggatggcaggattgtctctggcagtgatgggcatcgttggctgggccagtggactcgggtttggctggatctacacgttgggcaccgcaaacgtagtacgcagctggatgtcaccgccgacgctactagctctcggtaccgggcacgtgggtattctgctgggtctgggggatcacaccactgcagtgctgtcgttgacccgcggcatcggcgtactgatcatcatggtcatggcctgttggttgttgctagctgtgttccgcggtcggctacacccgatcggcggcctcggcgtcgcgctgggcgtcacggtgttgctgtttcccgtcgtgcaaccctggtatctgctgtgggccatcattccgctagccgcctgggcgacccgcaccggcttccgagtggctgcaatcaccgtcaccatcgtcgtgggcgtcttcggccctacggccaacggtgatcgtttcgcgctgttccaaattgtggatgccaccgtggccagcaccatcatcgtgttggtgctcattgcactaacctacacccgcttgccatggcgaccactccagatggtcccagccaagaggagcgaactggatcaacaactggtgagggttgttgcaccggacccggagacctcgcagaactccgcgtctcctgcgacccggctgccgaccgcctacgctaacttaacatgagctcggcctgcacagtccccgaaactcccgaagtcgtcatccggctacgcggggtatgcaagcactacgggtccatattggctgtatcgaacctcgatctggacatccattccgccgaggtactggccctgctggggcccaacggcgccggcaagacgacgacggttgagatgtgcgagggcttcgtacgtcccgatgccggcacgattgaggtactcggcctggaccctatcaccgacaacgcacgtctgcgcgcccgtatcggagtaatgttgcagggtgggggcggttacccagcagcacgcgcaggagaaatgctcaacctggtggcctcatatgccgctgacccgctggacccagagtggctgctggaaaccttaggcctcaccgacgttgcccgcaccacctaccggcgactgtccggcggccagcagcaacggcttgccctggcctgcacgttggtcggccgtcccgaactggtattcctggacgagcccaccgcgggcatggatacgcacgccaggctgctggtgtgggagttgatcgacacgctgcgccgagacggcgtgacagtggtgctgaccactcaccaactgaaagaggctgaggaactcgccgaccgactggtcatcattgaccacggacgcatgattgccgccggaacgccgaccgaattgatgcacaccggcgctaaagaccagctgcggtttagcgcgccgccgcggctggacttgtcactcttggcgttcgcactaccggaggactacaagaccacggagctcactccgggcgagtacttggtcgcaggccccatcgacccccaggtgctggcgaccgtcacggcttggtgcgcacaaatcaatgtgctgaccaccaatatgcgggtcgagcaacacagcctcgaagacgtgttcctggatctcaccggcaggaagttgcggtagtgacgcaaaacaacacactaaggaacagcccactatttcccgctggcactttcactccaaatccccgacccaacgccgtgacccggatggtggccgcacagtttatgctggagcttaagctgctgctacgcaacggcgagcaattgctgctgaccatgttcatcccgatcaccctgctgatcggcctcacactgctgccacttggctccttcggccaccatcgcgccaccacgtttgtaccggtcatcatggcgctggcagtggtctctagcgcattcaccgggcaagccatcgcggttgcttttgatcgtcgctacggcgcactcaaaagattcggagccaccccgctaccggtttggggtatcattgccggcaagtccctggcagtcgtaaccgttgtgttcttgcaggcaatcatcttgggcgccattggcgttatgctgggttggcggccggcgctgatctgtttggcgctgggtgcggcgatcatcgcgctgggcaccgcgggcttagcggcacttggcctgctgctcggcggcaccttgcgggccgagatcgtcctcgcagtagccaacctgatgtggttcgtgttcgccggacttggcgcgctaactgtcaagatgaacatgatctcggcggtggttaagtgggcagcccgcctaaccccctcgggtgcactgacagaggcgctgtcgcaggcgatgactctgtcggtggactggttcggggtcatcatcctgacggcatggggcacgctcgcggcgctcgcggcacttcactggttccggttcacctgatcccgatacgacgaccacgacacggcagctacggaaccgaacatcacccgccacccagtgactgggtctgaccacgtcattggccacttaagtggtggggtagcccgttaactcactacgccaagcaaacctactaccaggtgcccggcagcatcgccacccgcggaccagcgccgaatccatcaccgctcaacgtgcacaatctggcaggctgcacgaccgtctccttggcagccggtccccacaaaccccagtgctcgcactcctcgatcagagcagccaccaccacaaacacatcattttgttgacccgccgtccgcgtgagctggacaggcctagcggccaaaaatagaatgtcaaggctgccaatcaccacttactagcctaacagccagcccactaccgagcgagcaaccacctaaccgggctacttggtacccacggcgtcgcgataccgcgctgcgcttgctggaagtggccatcgaacgcccactcgcgccggatccacctgttgcaccgaaaccgtattgaaccagccccgggaatggtcctgccaggctgcagttacagcacccgactgtaccaatcccctactaccgggtgtagttttcattgtcttacgatcgtgcggtgcttgtcggacgaattctgttgcgactagtcgacctaatacccgaccctggtctgcgtgtccagcggatcattgccgcgaccgtcctcctaacccagggcggtattaccgtcaccggcgcgatcgttcgcgtcacggcgtccgggctaggctgtcccacctggccacagtgttttccgggcagcttcaccccggtcgccgtcaccgaggtaccacgaatccaccaggcagtcgaatttggtaaccgggtagtcagcatcgcagtggtcatcgccgcgttgctggccgttttaaccgttacccgggcgcgacgacgcaccgaagttcgggtctacgcttggctaatgccgatctcgacggtgctgcaggcggtcatcggcggcatcaccgtgcttaccgggctgctgtggtggacagtcgccatccatctactgacatcgatgattatggtgtggctggcggtgttgctctacgttaaggtcggtgaacccgatggtggaattgcttatgagcgggtaatccggccgctgtgcgcactgacagccctaaccgcagtaaatctggcggtggtgctggtaaccggcacgctggtgacggctgctggcccgcacgcgggagaccgcagtcccagccgcacggttccccggctaagagtcgaaatcaccaccctggcgcacctgcattcgtcgttgctggtcgcctacttagcactgctggttgggctgggcttcgggctattggcggtcggtgccacccgggccatcctggtgcggctcgccgtgttgttcgctctggtttgcgcgcaagccgctgttggcaccacacaatacttcaccggggtgcctgccgccctggtcgcagtccatgtagctggtgctgcggcgtgtaccgcagccaccgcagcgctatgggcctcaatgcgaacccggtcctaacccgagtcgctctcacgctaactccacacccagcgcaaattcgcattgggcatggtagcggataccggcgtccaatcatcgccagtctagcgacggttccaccagctgcaattccagtaaccgagacttccggcgaccatcgaccaagtgggcgcgcacatacagccactcgccgacgtcgatgcccgcctcggttgccgcagcctttagcaacgccgatatcccagatttcgaaatcgggctcggcctgaaccagcatgtcctgcttggtagacgtgcgctacagcctcaccactgatgaagatcggtaccgtttcttcgcccaacccgccgtctgcacgagaacggggtcggtccaccctggctcagttcagccacgtaggtagccaccgcggaccgatcgttgcaacaccatgtgccggtgccgacggtcgggctgacgaagacagcgccaggacccggccaccggacctgatcgcctggagctaacaccttagccgacaccgtcgacccccctcgattccccggatccgccaagtaacgccggtcgacattccaggtggcggcgatggatggattcagcagattgggcacaccaatggtccaggccaggtactcgtcgagctgttcagcgtagtcgtagatagcccgcaagactaccaggtccgcgctcgctgccgagctcgggatcgtcccagagcaaccactgggcgtgtaggccgtagcgtcgcagcagccagaacgagcccggcatcatcgccggcaccagcaacctgctggcgagaacccgccaacacgatgtggggatggaagaggtctggtcgtgcgatcttcatgcccgggcatggataagccacatgcatgcaaccgaaatcgtcgaaactggcgaccctgaagtcctgcgctatgtcgacaagccgccgcccagcccacgcaaggtaagctactgatcacggccgaaggtattgacataaacaacttcatcaacacctaatttccttcaacgaaaacgtatccgcccagtgccgttcatcctcggctcgaaagtatgcggtactgccgttgttgctggcgaggacgtcgacaccaacggtgtcgacgtaggagaccgggtggttagcgccacggctaacggaagctaggttgaatctttctctttaacagcatttttgaccgacaaagtgcccatgaggagtattttgaggcggcaacgtagtactactagatgccctggccgcccactctttactgaagtcggtgcacccggtgcggagctggtgatatggatggggggagctgatcaccgtctcgaatgcggaaaagcacaattgtccaacggggctgacgccgacaaggtgctgtactgtcccgaagctgcccaattcggccagcaaattcgggcactcaaccgaaggtgccccaatgtggcagcgttttatgccagcttagaggtaaccaactttgacgccaacatggctgtccgcgggacactggcactttttcgtgacacaagcggaaccgctgtgcctgtcgatccgcagcacctcaacgccgccggctcactctacctcacccggccgacgctggccaatttaatccgaaccggcgaggagttcagctgacggacccagtctaactgttcgaagcaatcggcagcggagccgtcaccatcgaggtcggtgtacacactacccgctgtccgaaaccacccgcacccacgaagatctgcaaggccgcaagaccgtcggctcggtcaagttgctgctttaagctcgagccaccaaagaggtgatcaaaatcaaaatagtgtcggcaaggcgagcaccgagtcgaccgctaacgcgcaaaacaccaccgccagatagttgtttgattgcaggaacagccgtagcggcttgaccggctcaccggcacagaccccgacgtataactgatgggccatcgttaaaaaccatgccccggcgacgacggccaccgccatgtacagccaccccgtcgccagtgccaacaccagcgtagacaatgcggtgagccaggtatagatcaatatctgtttggtgacgtgacgctcggtcgccacggccggaagcatcgggacgctggccactttgtagtcgtccttgtagcgcatcgccaatgcccaggtgtgcggcggagtccagaagaagatgatggcaaacattgccaatgctggccagccgatagtgtcggtgatcgccgaccaaccaatcatcaccggcatacacccagccgcaccgccccacacgacgttttgcgacgtccggcgcttgagcaacagcgtgtaaacgaatacgtagaacgcgacggtggcgagcgccagcagccccgacagcagattggtagtccaccacagccagaagaatgaacccgcagtcaacgccagcccgagcaccaaggcatttcgggggggcaccgcggcccgcgccagcggccgccgggaagtccgcttcatcagtttgtcgatatcggcgtcggcaacacagttgaacgtgttggcacctgcggcagccgatatcccgccgagtaacgtattgaggatcaacagcggattagcgctaccgcggtcggcgagcagcatcgctggtatggcggtgaccaaaagcagctcgatgacgcgcggcttggtcaacgccagatatgccaacactcggctccgcgctaagcgcgcgcgaacgctcacgtacttaactcctcgagatcgcagcagcgcgcagcttctactacgcacgatggtagaccgcatgcccgtagccaacagcccgacaggtctttcaacgcagatttttcccagattgcaaagagggcgcgaacagacgcaggctagttgcgccacagcgaaccgtaggtacctggaaaccgggccctgcaacaggcccgcacttccacactagggtgagattaatcagtttgatgacctgaacagctgacccaaggactgattcgtgaccacactcgaccagatctccacgctgacccaaccgcgccatcccgatgactggaccgagatcgattcggctgcagtcgacaccatcagggtgttggctaccgacgcggtccaaaaagctggcaacgggcacccggggacggcgatgagcttggccccgctggcctacactttgttccagcgcactctacgccacgaccccaatgacaccgcatggctgggtcgtgaccgattcgtgctgtcggccgggcatagcagcctgaccttatatatacaactctatctcggcggcttcggtctcgaactatctgacatcgaatcgctgcgcacctggggatccacaactcctgggcatccagagttccggcacactaagggtgttgagatcaccaccggcccactcggccagggtctagcatcagcagtcgggatggcgatggcatcacgttacgaacgtggcctgttcgaccccgacgctgaaccgggagccagccctttcgaccattacatttatgtgatcgcctccgacggggacatcgaagaaggggtgacatcggaagcgtcgtccctggccgcagtccagcaactcggcaacctcatcgtgttctacgaccacaaccagatctcgatcgaaggcgacaccaaaatcacgctgtgcgaggacaccgccgcacgctaccgcgcctacggctggcacgtacaagaggtggaaggtggcgagaacgtcgtcggcattgaggaagccatcgccaacgcgaaagccgccaccgaccggccgtcgttcatctcactgcgcaccatcatcggttatcccgcgccaaccttgataaacaccggcaaagcgcacggtgcggcccttggcgaagacgaggtagcggccactaagcgaatccttgggttcgatcccgacaagacctttgcagtccgcgaggacgtaatcacccacacccgcggcttgatagcccgcggcaaagaagcccacgaacgctggcaactagaattcgaagcgtgggcacagcgcgagcccgaacgcaaggcactgttggatcggttgctcgcccagcagcttcccgacggctgggatgctgacctgccgaactgggagccgaggtccaaggaattggccacccgcgccgcatctggtgcggtactatccgcgataggaccgaaactcccggagttgtggggcgggtcggccgatctagcgggcagcaacaacaccaccataaaagacgttgattcctttgggccgccgtcgatttcgaccgacgagtacaccgcacattggtatggtcgcaccttgcatttcggtgttcgcgaacacgcgatgggcgccattctgtccggcatcgtgctgcacggccccacccgcgcatatggtggtacatttctacaattctccgactacatgcgcccgtcggtgcgactggcgtcgttgatggatattgacacgatctacgtgtggacgcacgattcggtcggactcggcgaggacggcccaacccatcagcccatcgaacacctcgcagcgttgcgtgctatccctcgattgtcggtggtgcgtcccgccgatgccaacgaaacggcatatgcctggcgcacaatcctggctcgcggcgccaacagcggtccggtcgggctaatcctgacccggcagagtgtgccagtgttggaaggcaccaacaccgaaggcgtcgcccgaggcggctatgtgctaggcgatggtggcagctctgaagctaaggagcctgacgtcattttgatcgccaccggatccgaggtccaactcgctgtcgcagctcagaagttgttggcggataaagacatcattgtgcgggtggtgtcgatgccgtgtgtggaatggttcgagtcacagccgtacgagtatcgcgacagtgtgttgcccccgtcagtgtcggcacgggtggccgtcgaggccggcgtcgcgcaatgctggcataagctggtcggagacaccggcaagattgtgtccatcgagcactacggcgaatccgcagattaccagactttgttccgtgagtacggcttcacgccggaggccgtggttgccgcagcggaacaggtattggataactgaaaaaaaggcgatctgtatgacctcaaaaattcagaaccccaacctcgccgcattgagcgctgccggagtgtccgtttggttggacgacttgtcgcgagaccggttgcagtcaggcaacctacagaagctgattgacaccaagagtgtcgttggcgtgaccaccaacccgtccatcttccagaaagcattcgcaaacggccacgcctacgatgcccaaattgccgagctggccaagcgcggcgccaacgtagatgtcaccgtccgcaccgtcaccactgacgatgttcgccacgcatgcgacgtgttggcgtgtgaatgggaagcttcccacggaaaagatggccgagtctcgattgaagtcgatccccgtttagcacatgacaccgacaagactatcgcgcaagccgtcgaactatggagaatagttgaccacccgaacttgttcatcaagatcccggcgactaaggctggcctaccggcatcaccgccgttttagcggaaggcatttcggtcaacgtcacgctgattttctctgtacagcggcatcgcgaggtaattgacgcctacctggccgggatagaaaaggccgccgaagctggacgcgacctatccaagatagtctcagtagcatcgttttttgtctcccgcgtggacaccgaaatcgacaagcgactagaaaaacttggttccgagcaagcactcgcgctacgcggccaggccggtgtcgccaacgcccgattggcctacgcggcctaccagaaggccttcgaaggtggccagcgctaccagacactcatggcccgcggagcccaagtacagcgcccgctgtgggcgtcaaccggtgtcaagaaccccgattacgccgacaccctgtacgtcaccgagctggtagctccaaacacggtgaacactatgccggagacgacgattgatgccgtagccgatcacggtgtgatccgtggtgacacgatcagcggtactactttgtcctcccaaaaagtgttcgactcactggtggcggtcggagtcgatctgattgatgtgttcgcggtactagaacatgagggcgtgcagaagtttgtgaaatcctggaacgagctactcaaggaaactcaggaacagctggactccgtcgccaaatgaacccagtagccacacgtacctccactgcaactcaatggcagaacccgctacggtacaaggctaataggtagctacccagaatagccacccggtgcacgatggtgattttaggggtcaccggcgacctgtcccacaagttaaagtgatgtcagcaacttacgatatggccagccggaacctgtcaccacccatgttttccatggtagatcttcgcatgacgcgattttagcacccaggattgcagtgacgtcgtccacaacgccgtcaaagagcactgccggacgcatttctgcaggcgaactgaagccagctggaggaaggactccggttcgtatcgggctctttatgacaatgatgatgcgttcgcccgactggccgatgccatggacaagctggacaccaagcccaccaccagcggcaatcaggaattctaactggcgatcccacccaaatctttcccggtggtctgtgaccagcttcataagtctgaattggctcgtccacaaacctacagctggagccgggttgtcaccgagcaacccttcggccacgacctggacagtgcgcgcgacctaaacaagtctggcaacacagtcttcccggaagaagctgttttcggtatcgaccactacctgggcaaagaaacggtacagaacatcttggcgctccgattcgccaatcaactgtggattcctatctggaacgcacacgtgcagatcaccgtggctgaagacataagaacttagttaccgagccggttactacgacggcattagtgaggaccacgatgtcatccagaatcatctgatgcacctgctgacgttgatcgcgatggaaaagccagtcagcttcaatccagcttggttgcaagctgaaatgattaaattgctgtcggcgggtcacctcaccgtcccgttcaacggtaccatcaactgcggccacggccaatacgccgccggctggcaaggcggcgaaaagtggtcaggctggtcgacgaggacgagttcgccacggactccaacacccagagcttcgccgctatcaagctcgaagttgatactcggtgttgagccaaggtgctattgtacctacgagccgggaaacgactaggtcacagggtgaccgaaatcgctctggtcttcaaacgcgggccgcatcatcctttgcaacgccaccataccgacgagctctgcgccaacgctttggtcatccacgtacagcccggcgaagggattaccttgcggttaaactccaaagtcccggacagctcgatggaagtcaacgacgccgaatggacgacgaactactcgccaatcgcctaggatacaccggagaccgacgagcaactgatccttgatgtgttgcttagctggccgtacctgtttccggtcaatgcggaggtcgaatttagcttgggaaacactcgacccagcccttgccgattgggtggacacacggcaagcccgatctgcccgatataggaacctagggtccagaattatccttcgagatactatagcgccctagccgggaatggcagcgacgatgcagaacgaagcaatggtgaggaacaacacaaaatgatcgttgattttcccgacaccaccacagtggtcaatatagaaactagacgagctctgcgaaaggatcggcgccatcacgatgagtcgagtgcttacgctggtcatcacgccgtacagcaaagccatgctcaaagaatctatcgaggccgccaacggagccagccacaagtatcccaaccgaatcatcatcgcgatgagggtcaattcgtacgcgaataaagcgcgcttggatgcacaactgtgggtgggtgccgatacaggcgccggggtggtggtgtctagaactcttgctgtttacgcccacagcgtcgttatctcgatactgctccctgacatcccgatggtggcctggtggccgaacatcgccccaacgatgtccggccaagactccctgggcaagttggcaattcagcgtatcaccaacgccaccaacagtatcgacccgctggcaaccatcaagagccggctatccgattacaccgccgacgacacccacctggcatgggacctaataacctattggcgtgctctgctgacctccgcggtcaacctgccacctcacgagccgatcgatttggcactggtttccggcatgaagaccgaacccgcgctcgacgttctggccggctggttagccaaccggatcaacagaccgttgcgccgagcggtcgccgatctgaaggtcgaactgatacgcaatagcgaaaccatcgtcttaagccgacctcagacttgggtgacctctaccctgatccgaaccgtgaaaccagatgcactagttccctggggcgcgcagggaagccgaggagttcctagccgaaaatctgcgacgactggatcccgacaagttctacttcaatgccttcgaaggcattgaaaaggttcagtacctgtgagcgccagtgtagagatcttttcagacagcaagaccatggtcggagccgccggaaaacgacttgccagcaccatccaatccgccgtggctgccagagaaagggcactgattgtgctgaccggtggtagcagcggcattggactactgcgggatttagctacacgtggacagcagatcgattggtctagggtgcatctattctggggcgacgagcgctacgtacccaaagacgacgacgagcgcaacgagaaacaggcacgtgtagcgttgctcgatcacatagacatcccgcccagccaggtgcacccgatgcctgcgggcgacggtgaattcggcaacgatctagaagcagcggcactagcttacgaacagctgctggctgcctacgccgcacccggttatcccaccccgaattttgatgtgcacctgatgggcatgggacccgaaggacacatcaattcgctgttcccaaataccgtagctgtgcgcgagaccagtcgtatggtggtcggagtcaggaactctccaaaaccacctccagaacgaatcaccttgacacttaatgccattcaacgttctcgtgaggtatggctgatggtttccgggacggcaaaggccgacgcagtggcagccgccatgggtggcgctccctctgcctcaataccggccgccggagctgtcgggcttgaaaccacactctggctgctggacgaagaagccgcagccaagattcctggctagtggcgtcataatgaccttcatggctgacagaaccgtgcgcagcagactggagcgaaggcgattatctacagagatgatgctgtcgcggttatcagccaccgaatacgccggtccgtggtgtgctagataggctccgaaatcggaccatgcaatgcaaatagcacagccagctatccgaggcctgatgatgtcgcctccccccgatcccgagcctcgccccgggttagccgctgttacgtagcgcgctggccaatccgttcattgtcaaaaggatgccgcgttgcaccatttcgtcgtcgtgacccgagcggtagcggcgcaatagctccacctgaaggtggtttaacggctccagatacgggaagcggttgaacaccgaacgcgccagagccgggttgtcagcaagcagatcgtcatgacccgtaatgagcttgtggatggcaatggttcgccgatgctcgtcggcgatcttgtcaaacactctgcgccgcaaggcttcgtcgaccaccagctcagcatagcgggccgccaggcccagatcacttttggccagtacctgcgccatgttcgacagcacacttcgaaagaacggccaacgctgatagaggtcatgcagcatttctacccgctgtgattcactttcgggtccagccgcaacccactgctgaaacgccgatccggtgccataccaacctgggagcatgactcgcgattggctccatgccagtacccacggaatagcacgaagatccgcgatcgacgtggtaggcttacgtgatgtcggtcggttgccaatgttcaacgatccgatctcgctgaccggcgtggaagcttggaaatagtcaacgaaacccggtgtgttgactaattcagcgtaggatcgccgcgcgaggccggctacttcatcgagtatggcgtaagcagattcagccgcatcgcctaagccttcaacatccaagagagttgattctagggtcgcggccaccaaactctctaggtttcgtcgtgctatttgcggttcggcgtatttggcggctatgacctcgccttgctcggtgagacgcaacgagccgtttaccgcccccgggggttgcgccagaatagcttgatagctaggaccgccgccacgtccgacagtgccgccacgaccatggaaaagtcgcaaacggattccggttttgcgggccacgtctaccagagcgagctcggcgcggtaaaccgcccagttggcggccagatagccgccatctttgttggaatcggagtagccgagcatcacttcctgccagttaccgcgagcagccaccagcgttcgatatagcggaagttccagcatcgcgtgcagaatggccgccccgttgtgcagatcgtcgatcgtctcgaacagcggcgagatgcccaccggacagtacggctgcgacccggaggcgtctaacaggccagtctccttcaagaggatcgcgacctccaggacatccgacacagactgacacatcgagatgatgtagttgggcaccgcggccgatccgtagagctcaacggcgtgggcagcggccgcaagaacggccagctcgccgcgcgccaaatcggataattgcgcacgatccccgaccaacgggcggcggttaccgagttcggccaccagcagcttgactctttgatcttcgggcaacgaactgtagtcctggtgcatcccggcccacgccaacagctcagcgaccacctcttcgtgcacgtcggaattttgccgcatatccagaccgcacaagtgaaacccaaagactccaacaccttctcgcaacagcgccaaccgatcgtcggctaacaacgcggcgccgtgcgtgcacagggaggcttcgatggtgtccagatcggcacatagttcggctggcgtcgaatacggtggcaaacccagaccaagctggttgggtggctgctgatccaggatgtgggcggcagtcgaggacaatcgaccgcggatcacccgcaatgcccgccggtacggctcgtcggcacaggccgcgtcctgacagctagcggccagcgtggccagctcaggggtgacggttatcagtcgcgccgacatcgacagctcctgctcgaggtgggtgagttcagccaaatagtgcgccaccacggtgtaggcagcgctgccggtcgctcgccgcaccacgtcggcagtcacgttcgggtttccgtcccggtcaccaccgatccacgatccgggttgcagtatagggccggacagcagctcggcgtcgggccaccgggcacgcaacgcgttgcgcacctcggaattcacctgcggaatcacatggaaaagcgcggcagagtaatatcgcagccctacgtcgatctcgtcggagatctgcaatcgcgccaaccgaatcaatgccgtctgccacagcgtgagaatttgacggcgcaattcacgctcaatgctgcggccatcggcggtttcggtgtgtccctccgcgtgcagccgcatcaactcggtaatccggcgttgggtaacaaatacggtacgccgacgggtctcggtgggatgcgcagtaatcaccggcgagaccactgcaccagtaagggcatctgccacggtggccgaatctagttttgccagatcaagtttcgcgtaagtggccgctaaactgctatcccgcagtggctcgccggcgtcgaggtgaatatggcgccgacgctcccggtggatgtcctcggcaacgttggccaacaatgcgaaatggctaaacgcccggatgatcgggatggccaggtgaatgtcgagaccagagaacatacgcgccatatcggcccgatcaatctcagaacgccgcacccggaacgactcgacccggactcgttcgacgagatcgaatacctcatcaccgttctgctcacgcagagtatcaccaagaatggtacccaatagcctgatgtcggcccgcataggttcagtcgcctcgcgaccgactcgagtccgctggacagcaccgatcggttccagtatagcatcggaaaactcaaccatgtgtgcggggatctacttgaagtaacagtgctaacggtatttagttagcagggctacgccgataatggataccagccagattccggtgacgaacagcgtcaaccggtccaggttcttctccaccaccgtcgacccggacagactggattgcacgccaccgccgaacaacgtcgacaggccaccacccttcgcacggtgcaaaagtactaacaacactacgaggatgctggtgacaaccagggtgatctgcagggccaactccatggtcaactagactacctgtctaccgtcgaacggccccagcatagtcgagtcacaggctggcacacccagtcctcttgctgctcgtggatcagcagcgtcagcacagcgacgagtccggccgacagtacagcaaggccgggccagtcttccgcggtcctcgcgttcccggtaccgaccgaaagcaacagaacctcgacgatgaccgcgaacacgtcctgcaagatattgacaccagacgccatccagcccccgtacccgcggcctcaaggattactccaccgacgagcgggccgagctcgaccaaaaggtcaccgtgtgccgttgccgaggttacggcgatgccggtttttccagtactgctgccagtgaccaataatgccgaccgatcattccagcggagacaacacattagcttccgatgtacacacagcacagctatactgcattttcgtttaatttccgctacgagcatcggagagatgcatatcctacctcaccctaacatcgggtcataacacgaaatctgatgtgatccggtggactggtaccgatatagtgttgaaacagcggccaaacccagagccactgcacgacatcccttcctaattgcatcatagtagcacacccccacccggtgcgcctagcccggatcctgacggtccgcatagtgcgggcacctggcggtgggagcacgcgttccggcggccgcttaacttaagcgccacggcagtctctgatcgaagcggttcagccgacgctgtacctcattgatcagcgtggtcggatcccgacccggcgtacactgccgaactgatcgcgtacacagcgtcctccagttcaatggtagccgaaataatctgctcagcatgtggaactcactgccagttgccagaggctccaacaccgcggcctcgacagtggcacaaacctgatgcgcaagccaatagacgtagtcgcgggacaattgctaacataggcgtttgctagcataagcattgaccggatgatttgaccgcctcgacgagaatagctccgggccgcaccaagcccgggcgattcaggcaaccaccgatctcccggccacaacaggtatacgacacacaaccaccacagtgctgattagcatgtctactaggcacaccgcgggcgctaccggatacgcaaggcagatcgattgcgacaacaacgccgcggaagtgattacaataacgccgaaaccatacagtttcggcaccgatagcacgacaaaactcagcgccagcacggttgcgaccaccaaagcaggctagcagcgcaaaccgccagcaatcagtcacagcaacgcaccaatcaccgtgctgaagaccaatgaaccgtacggacgaacaccgaagcataccctgaccacaccattacggcggtggtcaacagcagccaaaacgagtggagagctttcacgcatcgcgcataataatgccggtggccacggccaggaaagtctgattcgcacgctgttgaacaggacggtatgggaagctagcggcacaaatcaacaccgacagtcggcgagtcgctagcacggcatcccccggcgcgccaacttctaggctgagcgcatccaccaactccaccaacccagagtcccgaccggcatccaccaccgccaactcgaccgataccgaccatgcacgcttgaatctggttgccgtactagcaaatcgcaacgatcgcatcgtcgaataccgtgcgaacctgggtatatgtagggtcaccactggtcgcggtagaacccggtagcaaccaggctaacgccgcagaacgcgcctaggaacaccagcacgacaacctgaaagatcgctgacagcacaccgatgcccgcgatcaacgccacagtggccaccacacccacccgacaggcacactgaacccatagcgaattagccacccacagcactgagctaacgctacggctaaagtctgcagcataacctatcaccaagtcagtgcaagacgccccgagggcttccctagggaagaggcccaccggcggcgatgaccgcgagcgtcgcgaattgcgccccgtccagcgacgctcccccaaccagaccaccatcgacgtcttgctgggcgacgatatcgccaatgtttttggcgttcaacgagccaccataaagcacccgaacggtttcggccacctgcggtgatgccagcgcacccagctcttttcggatcgcctcgcacacctcttgggcgtcggctgcactagccacccgcccagtcccgatcgcccagaccggttcataaacgatcacgacattgccgatctgttcaggcgacagcccagccagcgagccgcgtagctggttctggcagtggctgacgtgttcacccacctctcggatctcgaggtactcgccgatgcacacgatcggagtcaagctgtttttgagcgccgcagccgtcttcgcggccaccagcgcgtcaccttcgtcgtggtaggtgcgccgctcagagtgccccaccagcacgaagctacagcccaacttagccaagaaggccccactgatgtctccagtgtaggcgcctaggtcatgttgcgaaagatcctgggcaccataggtcaatcgcaacttatcgccatcgaccagggtttgcacgctacgcaggtcagtgaatggcggaagaactgtgacatcaaccttgtcataatacttgtccggcaatgaaaaagcgattttttgcaccaacgcaatcgcctcgaaatgattcaggttcatcttccagttgccggcgatgagcgacttgcggctcacgagtctcctccccttggctgctcacgacctagtacctcgatcccgggtagcgtcttgccctcaaggtattccaacgacgcgccgccaccggtggaaaggtgcgagacactgccttcgggtaggctgagcgcccgcatcgcagccgcagagtcaccgccgccgaccacgctgaaagctcccttgccagtaacagccacgattgcttcagcaacacctctggtgcccgcggcgtacgcagggaattcgaacacgcccatcggtccgttccagaaaatggtcgaggcgttggataacaacgtagcgaaccgcttgaccgattccggcccgatatccagtcccatcaatccatctgggatagcgtcggcggcgacggtctgcggcggcgaatcagcgacgaacttctctgtcaccacaatgtccataggaagccgaagcacgtcagcgtaggtgtccaacagactacgacaggtctcgatcatctcggtttccaataacgatttacctactgaaaatccttgtgcagcaagaaatgtaaagcacattccacctccgagtacgatgctatcggcttttgtcgccagcgactcgatgacgccgagcttgtcggataccttcgacccgccgagcaccactgcgtaggggcgtttggccgaactagtcaattgctcgagtatccttatctcgtcagcaaccagtatgccggcgtagtgcggcaatagcgtagcgacgtcatacaccgaagcctgcctgcgatgcaccacaccgaatccatccgaaacaaaagctcctgctgacccgaccaattcaaccaattgcttggccagagcgagtcgttcgtcgtcgactttgctggtctcgcgcggatcgaagcggatgttctgcagcagtaggaggtcgccgtcggtcagcctctcaacacaggcgagcgcatcacccccgacaggggaacgatcggtgctgcagaccaactggacgttttggcccagctgctcaccgagcgccgcggcgaccggctccagtgacagctttgggtctggcccgttcttggggcggcccagatgggcggcaaccacaatcttggctccggcctcaagcagcgctttcaacgtaggcaccgacgcggtgacccgaccgaggtcggtgatggcgccatcatcccccagcgggacgttcagatcgcagcgcaccaacacgcagcgaccagaaacaccttcctcaagaagatctttaagattaggaatgcgcacggctaaagtgacttgccaaccaggccgaccagatcaaccagacggttggagtagccccactcgttatcgtaccaggacaccaccttggcctggctggcgataactttggtaaggccggagtcgaagatcgaactgtgcgggtcggtgacgatgtcgctagagacgatcggggcatcaacgtacttcaggatgcctttaagccgaccctcagcggcgtcctgaaacaccgcgttgatctcattgacactgacgcacttggacaagtcggctgtcaggtcggtaaccgagccggtagggatcggcacccgcagtgcgtaaccgtcaagcttacccttaagctcaggcatcaccaggccgatcgccttggccgcaccggtagaggtcggcacaacgttcagcgcggcagcgcgggcacgacgcaggtcagaatgcggtccatcctgcaggttctggtcttgagtgtacgcgtggacggtggtcatcaaacccttaacgatgccgaattggtcgtgcagcactttcgccagcggtgcaaggcaattcgtcgtacacgacgcattggagatgatgttctggctgccgtcgtacttgtcgtcgttgaccccgaacacgatggtgatatcgggatcagtggcaggtgccgaaacgatcactttcttggcgccggcctccaagtgccctttggccttggccgcgttggtgaacaagccggtcgactcgacgacaacgtcgacgccgaaggcatgccacggcaatgccgctggaccttctcgaaccgcaagagccttgattttctcggagccaaccacgattgtatcctcttcctcgaggctaacatcgtgtggcagccggcccaggatggagtcgaatttgagcaggtacgccagcgtgctgttgtcggtgatgtcgttgatggcgactacttgcacgtcggcaataccatgttcctgttgggccaataacgcccggtagaagttgcgtccgatgcggccgaagccgttaatgcccacgcggaccgtcactggtctctcccttgtcgtcttcaatcggctaatgaactgctcgccgtcaccctagatcaatgacaggtagccgaagtcatggaccggttgagcatgtcacactgcagcagctacgcctaacaagcgtcgatggacgcatataactcatataaatatagaatatacgataactcatataactatatatagaacatacgaccgagactgtccgccgctaatcctgggggccggtgtctgcaaacagccgctgaacacatatcaacttctcggtcaccatgccgatacaacacagctggataccgagtcgcggcagcggaatacgagcatctcccccaggtgctgaacgcgcaactaaaacttgaccgagacttgaccaagctatctagcgcgtgcgtacccgctcactcggcatggacccctaccatcgccaacatcaacaacattttggtcatctcaaaggtgatgggaattatgcgggcagcaattcgaggtgttcttgtggtgatcgggatcgcggcgacggtgatcgcgggaccggtgcgtgtaagcctagcggcggtgaaccatgcgcatggcttcgccatcacgtcaattctacctacacgggacgcggtggtgggtgtggcgcaccccgtggtagtgacattcggcgcacccgtcactaaccgtaaggcgaccgagctttcccttaaagtgcgctcggcgccagcgatgaacggcaagtttgactggctcgacagcaaagttgtgcagtgggttcctgaccgctattggccagagcacagcacgatcgcactcacggtgggcaacctgtccaccaacttcaaaacgggtcctgccattctcggtattgcggatatctcgaatcacacgttcacggtgacgatcgacggagtcgaggcggagacaccccctccactgccttcaccccaccatcggccccactggggagaagaaggggtgatgccggcctcgatgggtaagacagaattcccgacacctaccggtaagtataccgtcatgtccaaggatcgctcggtgattatggattcgagtagtgtcggcatacctgtcgacgatcccgaggggtacaggctctcggtggattacgccgtccgtatcagcagccgtggcctctacatccattcggctccgtgggcggtgcagtcaatgggttttgataacaccagccacggctgcattagcttaagccctgccgacgcagaatggtactacaacacagttaacattggtgacccggtaatcgtgaaggaataacgggtgtacactcgctttttccaagacgtggcaatggaaaatcgattgaaagttgacaccatcgtctgtctggatgatctatatctatacgagtgaagagcagtcgttcaagggcacccgtaatcgggagtagtcgagaatcgcggataaattagcattcaccgattgtcgttgccgattgtttcgctaagagacacggaggcggttgaggccaaggcgttcaagattcgcctagaggccggaattggacaccacccatgtcgtggtagtgttaccgttacattacagctatcttagcagattctaagctagcttagctagtctcagcgaagctaaattgttgagtcaagtttaacatgccaggttaggtagttggtgttaggaatcgaattattttgtgcgactgaaggtttcgagagcaatcttgtaattacgaaaagctgcttgcagtggcggtgtggtcggcgaagtgatggatgcccaactaagatgcaacagccagtcaaccaaccacggctcaaggtcatacggcctaccggcacgccgttcacggccttcacccgccaaatcaagacaaccccagacacgcataaccggactggggcaaacgccggttagcactaaaggcgtaggcttcgatgctcgatacgcttctgctgcaacatgacctgaccgagctagcctacgctaccatgaatagcgtggcagccatcctctcgattgtcgttgcaagcgcgccctggcgtggtttgacacgttcgatgcgaaccgggtcaccgctgcacggcatgttggggatgaccacctcagcatagctgcccaaacaagcaaattaacccagcgaaccgaactgcttgcacccgactcgagcaatgagcttgagcacgaacggatccctccaccaactcgggttaagcaagcatcgtcatcacgcaccacggcaccggtacgacgacatgaacgacaaccccggcaccgatatacaaatctcaacccgcccagtcgtcctcgcaacccaattcgccaacgtaattgataagatgttcggccgtcgacaccgcggaccagtccccgtcaggggattcggcccccagattgcgtactgtgttcgtagccacgatatgcaagaaatcatgtccagctgtgtcccggatgttaccatcacgatgaagaattccaccacacggtcgtcctattcgtcagaaggattggtcgtgatcgcatccccaccactgcatccaggccaagctcgtcagtgtccgattagagttcctccgtgacagcgccctacggagtgctggttaccaaacgcacatatcgaccccgtaggaccgtcacgcggcgtgtaagcccgggccgggtcgtgttttaccatggtgtcgccgggaaaaatgatctcgatctgcagagcgggcgtgtccggaccgggcaaagcaaggaattgcgcacaactatccagcagcgcaccatatcgcttgggaagcttggcggtaattcatttcgggtcttgaagtccacgaaaccgtaggcgcagtgaccgactacgccaccgaggccgaggaagctccctcctcaccctgcgttgactgcactaggtaatgtcagagccggtcaacgaacgcgcctgtcattcgcttacaattccctcgagttttacgtagcgggctaagctaaagttactgctccataaagccttctgaactgatgtagacgcagaattaatacgattctggagtaaccaaaaattctggctaccttcgatgtgatctggcatgtctttcaacgccgatctttttccgcagcacagcccatttcagtgatcagatgcgcgatgtaaccagaatagctcggctccgctcaaaatataaaaaccgaggttaactcaatttttgtgtaaacaggcagcaggaacttcgaagtaggtcgttggtgttatgcggcgaaggaactgttctggagctgtcggagattattggttcatgtcacttcggtcggggtggctgtctgctggtagcgctgttcgtatgcgactggtggtcggtattggattgatattgatgaggtggagtctcgatcgtgttgtactagtgcacccaggaggtggtttcccgttccagttcgacgcgaccggtgaaggtcgcatgttggtcgattaattcagatttgtaccgtccctatagcagaatccataaacacgttgtccaaagcgtcgccgacactgctgatggatccggcgataccggcctcgtgcagcgcctcggtgaacgcgatcgacgtatattgatcccgcgtccaagtgatgaatcaaatcggttatagagaatggagctatgtgcaatagggggtgagtagcgtctgctcaagcaccgatgtgaccaagcacccgcggtcttgctggtcactggatcctagtattctatagtgtcacctaaatcgtatgtgtatgatacataaggttatgtattaatt

SEQ ID NO: 128 - DNA (genomic), 42988 bp, MYCOBACTERIUM LEPRAE; double-stranded, circular
  hypothetical: NO
  anti-sense: NO
gcggctacgacaatgggcagctgggttacccccaacaatcgcgccaccccgtaaatcacgctgccgagtagaatcaccagtagtaaccgcgccgccgcgtaaagcaagacgtttacgactaggtgatcccggttgtgatctgcagcgcagatgctgtttggcccctttgacacggtttgagcttacggcgcgagtatattcgctccaaggaggtgtcgagtgctttacctgctcctcgtcctggttttagggacactgttctacattggctggcgcgctgcgcaggcgcaggccaaccggccgaaaactcgcgttatcggacctgacgacgacccagagttcttgtggcgactcgagcatcgggacgataacccgcgttaaaccggggagcccgtcggtgagaactgctgccagctcagtgagcgcttcacgagtctgtcgccgcaaccaagccaggttaatctcggcgccctcctcccagatgtgggtgcaaaaagcgccaacctcaccgctcggcagcgtcgcgagaaatgaccaccaatggccagcacgacgacatggccgaatgcagcagcactggaccacagtcagtcaccatcaggccgtagaaccgctccaggatttcctgaatgcaactatagtcgtcagcgctagatgcgcgtcggaaaccgtcagatcactttccgacgccagcacttccagccccgctcgagccttgcgaggtgtaacggcggacattgctttattccggcgtcgtgccgtaactggcgcatagtagccgagggttccaacggaaacttctgctcaaggtgccgcgatcgggattgacatctaccggccactacccggtcgcctcggacagcagcgaacacgaacccagcggcccgtgatgaattgtggttttgccgcccccacccttcagcgacagcatagcaatcgggtagcaaccccgcaccgggcaatcgacctgggctaccaaatcactacagtcagagaccctagagctttccatcaggttaatcagctagccggatgcctttaaaggatagaccgccagaactccagcaatggaaatctggcggcccacatgaacatccgggtgtacaattccggatacagcgtgtgtggcacggactcaagaaggtgctagacaccaacggctccgctgacctctctgcacataatagctgccgaatttctgccacgtcaacctgcaggacgccggtaaccagaggtggatcccagtgcggcatccgggacaggcgatgcgggtgttggtagaggtgtcctggccagcgggtcaggcccaggggacgccgctatctgcaaaatccaacaaaggcaagggtcggtactacactgccggattcgctgggtaggtcgccggactacggttgaagcggcaactgtgtcgtaggattatcaatgtcgccatagccatcataagttcggagcgtctacaaccgtgaatgctcggagagacgactactccattggctgcagtactcagccgtccaccaacaagtattcagtccactcccgcatacgaatgcagacctacagtcaccaggttaacgaaaaacaggttgaagaccatagcaacacacccgaccacgttgatccacgccgccctcctgtcccgccatcccgcggtcgacctggcatgtagataagctgcgtatactacccacgcaacaaaagaaaccgtctccttgggatcccagccccagtacctgccccaggcttgctcggcccagatcgcaccaaagatcaccccgaaaccaaacaccggaaacgcaaagatcgtcgttcgataggcgatccggtccagggtctgtgcgtcagggaaccgccgcaccagccgggccagtgcctttgcaccttcggggtcggaggccaccagccgcgaggtgctcagcaggaacaagatgctggcgatgccggcgaccaggaaaatccccgagccgaggctgaccaccgacacgtggatgggcagccagtaggactgcagcgccgggatcaccggtgcggcgttggcgtagagccaccgaccggaaatcgtgagcaggatcaacaccgacaccagcaagaaaacccacagcgggcggtactgtcgccgacgcaacacgatcgcgccggcgaccagctcggagaagcaggtcaggttaatgaactcatacatattgccccaaggcacacgcagggtggccaggccgcgcagcaatatgcacgctagcaagagaccgatgccaaggtaggccacggccaacccagcctgcccgacacgttcgccgaacggccgttgcagagagtccaccacgataccgggggtcccgctgtcggcggcgaccgacccgggcaccacccgcgtgcggttgtctaaccggcggctgccaacgtacgctagctcgtaagccaacagtagcagagcgaccaccaacgccaccacggccgaggtgaacgcccagtcggagtagcacgccaggccgatgttgacgtgcagagtgttcatttgacgtccatttgagaactccttctggccgctgcaagcgtccggtcagccgcgacgagcccggccaatagccgctccgtcaatcgctcgaattcatcgccccatccggaattgtcggtgcgggccaggccgcctagttcgacgttcaccgtaccggccgccggggtgagcctgacccacacccggcgacgacgcaccatcagcgacaccactagcccgaccatcatcgctatggcgaaaacaaatacccaagcctggccgggatcatgtgacacctgcaaattgacgaacggcacagccccatcgaagcgcaccacggtgccagcccctggaccttggccaagccggacctgttcgccggcctgcagattgacccgtttctctttggtcagccggccctgattgatcagccggggatccagagtgaacaacgactgaggccgcccgctgtccaggccggtatcgccgcggtaaatgtcgatggctaccgcggggcgttcagcgctgggaaacgcgacaacaacaaggtgccgtctagctgctcggtcggtgccaacaggccttggatcgcgatctcgtgttgacgacgctcgctcatgttgggatagctgcctgcgggtgggtcgatgcgcaccacgcccgacgacagtagcgtctgctggttttcaggtcgccattgcacggtcgacgtgcgcgtctgtccgtcggggaatgtcacagtgaaggtgggcgcgtagccgtggccctgcaagtacacccggttaccggcgacgcgcagtgggtggttgacttccaaccggtagggccgccagctattcaccgtcaaatcgtgaccatcctgatagtcaatatccgcagtaaacgacatagcctgtcccgagggcaagtaatgtgccgcaaagtcgtttacccgaatgcaaatcggatgcaacgaagttccgtcgacggtgttgccggcacggaacgcatcgaatgcagccggcgatgctgagcaaaagccaggtccaccgtcagcgatgacaacaacattgccctcgtaaccgaacagcttgtcgacggccaccgcaaccagcaggcccagcagcgaaaagtgaaagaccaggttgccgaattcacgcaggtaacccttttcagcggacaccacggtttcggggactacaccgtcttgagtgcgaatgaccgtgcgccagccgcgcagcctgccagcgatggtgcccgctagagtcttgtcatcaccgatgacctggaagctggcgtgcttgggcagccgggccaggttgcgtggggcaatcaccggcatggcgcgcagactgcgggcatgctcgatcatccgcggggtcagacagccgacgagggatacgaacagtaacgtgtagatggcggtgaaccagacgctggaaaacacgttgaaggcctgcaactggtccagccacgacccgattaccgggtgagcagccacgtagtcgtcgaccttgccaacgttgaggtcgcgctgcgcagcaacgcaccgggtatagcgccaagcgcaagcaaaaacaacagcaccagcgcagtacccatcgaggtaagcgcacgccacgtgttgcgcacccaggccagaagccgcatgagaacctgcatcaaatcgacaccctcatgtcactgacgacggcatccctcagccacgaaacaaagtcatcccacaccccggcgatcagtgccgcaccgatcgctatcaggagcatgccgccaaagacttggatggcccggccgtattgccgtaaccacctcaagccggccaccgcctgcgcagaaccggacgctaacagcacgaacgggattcctaagcccatgcagtaggcaattaccagtagaatcccgcgcgtcacatttacgccgtcggtggccgcagcaaccgtgattaccccactcaacgtcggccctaagcacggcgtccagccgagcgcaaatactgtgccaagcaccggcgcccccgccaccgtcgtcaactgccgcaagctaaactgaacctggcgctgcaaggcagggagcaaacccacgaacaccagccccatcactatggtcagcacacctccgacccgctgcagcagcacctgatgggtggtcagcacagtggtcatccccaggacggcgacggtgtcgaggacgaacaccgtggtgaacccagcaacgaacagcaccgcggatcctgccacccgccatctggcggcaggtggggttttgatcacaccggcccctggctgcgtctcttcgtgagaaacaccaacgaccgccgccagatacgagaggtagccaggcaccagcggcaccacacacggtgagacaaacgacaccagccccgctagcatacacacccctagcgccaccaacagcggtcccgctgcggcaatctcggtgaagccggtcatgacgttccccgcggcagttgacccgccacggtttcgtgcgccaccctagccaccacaggttgcaaatccccggcgagcaattcccgcagaaataccgccgcgacccgatgctgacggtccagcaccaacgtgaatgggatcacggtggtcgggtatttgtcgccgaaagcaatcagagtccgcatcgccgggtcgtagatcgacgggaacgtgacctggcggtcgttgacgaaatcctgggccgcctggcggttgttatcgcggacatcgataccgaggaaggatactccggaatctcgggtagcattatagacctgctgcagttgggtcacttcggtccggcaaggcccacaccactggccccaaacattaataacgacaacgtttcccgtgaagtcgtccagcgcgaccgtccgctcaggatccgccagatccagcccggacagcggccccgggcggccacggctcgcgggtggctcgtagaagatgtcggtcttgccgtcgggcgagacaaattcaaaggtgccgccttggactaccgcatcgcgacccgaacagcccgctagcagggtcgccaacagtgcaccggcgttcgccagccgccagattatcgtggcaccactcctccgcatcgcttcgctctgcatcgtcgccggcgctatcaagtgcccgccggctgggaatactccacctcgaccagccggtcatcgtcgtagacaaaggtcgtaaccgaggccaacgcacagtctcggcgccgcggatcgtgccaaagtcgcttgccggtcaagtgtagccgcaacgtccacacaggtagttgatggctgacacacaccacctcatggccggcgccgcgggtacgtgccttgtccatcgcagtcgtcatccgagcagcaatttcgatgtaggattccccccatgacggggtgaatgggttgcgcagctgccaccacaaccgagggtcccgccaggtgctgccgcccaggccgacacgtcgcccctcgaagaaactgaccgattcgatcagatcggggtcggtgtccacgggcaggttgtgcttctcagcaatgggtgccgcagtctcctgtgcccgctgtagcggagaagcgattaccgcaacgacatcacggtcggccaacgcatcagcgactgcggccacttgcgctctacccgtctcagacaggccaaacccggcgagtcgaccgtagaggatcccggtggggttgtccacctcaccgtgacgcaccacatggacccgattatgttcggccatcaggactcccgatgccgggcggcgactgcggcagcggccgcaccgggcagagcatcaacgatgcgaccgaacgcggcgtcgtcgagagcggccgagacaaaccacgcctcgaacgtactgcacggcgggtagacgcccgcgtccagcaaggcatgaaaaaacgccggataacgccagacctggctgttgcaagcggacgcaaagtcggtcacaggcgcttcggaaaagaacacgctgaacatattgccggcacgcggaatctgatgtggaacaccggcatccgtaagcgcctcagacagcattgcaaccaaccggtcggcgttgcggtccagtgtagcataaactgcgtcggcggcagcccgtagcgttgccagcccggcggccatcgccaccgggttacccgacagagtccccgcctgatacaccggccccaacggcgccagcctctccatcacctcagctcgcccgccgaacgcagcggccggcattccgccgctcatcaccttcccgaagatgaacaagtcagcggcgaccggatcgagcccgtaccaaccacttcggctgacccggaaaccggtcatcacctcgtcgatgatcagtagcgcaccatgctctgcggtgatcgcgcgcagcgccgcgttgtagccgggcgcgggtgggacaactcccatattgccgggactcgcttcggtaatcaccgcggcgatctggtcccccaaccgggcaaacgtctgccgaacggcctcgatgtcattgtagggcaacacaattgtgtcagctgcggcggctccagtcactcccggcgaggacggtaggctcagcgtcgccaccccagagcccgcgtcggctaatagcgcgtccacatggccgtgatagcagccagagaactttatgatcttggtccgtccggtgaatccacgggccaaccggaccgcgctcatggtggcttcagtgccagagttcaccagccgtattcgctcgacgggcgccatccgcccgatgatctcggcggccagctgcgtctccgccggagtcggtgccccgaacgacagcccggaggcagcaacggtagcgacagcgtcaaccacggcgggatgcgcatgaccgaggatcatcggcccccacgagcagaccagatcgacatagcggcggccgtcggcgtcggttagccagcaaccgcgcgcttcggtgatgaagagcggggtgccaccgaccgccgagaaggcgcgtaccggggagttcaccccaccgggaatgacggcgcaggcatcctcaaacagcttcgccgaaatgcttacggctgggccggccggtgcggttgcctggtcagtgctgcccacgattaccagtgttccagcctccacgactcgttgaactacagggtgtaagaattcggcgcaactttaggtcggcccaagtcgacaagttggataacgacatgcaactacactcaatggctagcccaataacccgcccggaccgcacatcaacagtcccattaagcagccgtgtgccagctggctacccatgtacagcactctcggacacgtcgagcggagatccgacaaagcttacagcaaaccgttggtggtgtttcacgacaacatcaacgaacagctcgggtttgcgatcctgctgacataaggctccgaccgtgactgactgaataacctcagcgcagcaagatgtgggaggctgcgccgcagcagcaaaagctacagtgtcaccgacccccagttcaccgctaaggccgatgcggcccaacacgtacgtatcggccggcggccttccgcgaggccgcctgcctagcaagcagtgctgatcactccgaccgcgtgagtgttaacccgcacggtggtcgaattgtttaatcccggcggcccagcccgcatcagcgcaggcgccagacttgggggtgctcactgcactgatccggccaaaaaccagcttgcggtactgctttacgcagcgtggcgttccacatacagatggcgtcctggcgtcgctgtcctgctgatcaacaaaaccgaccaacggcagatccggaatgcggagccatcttcctcattgccgacgaaggacaagcaacgagcgcagccaccacaccaagtagactttgatatttagacctggatagaaatatcgccaaagacatcctggttcacgacagaggaagagaatattttcacgtttccacgagttgggacaccacgcgaaccgacgatcatcatcggctaaatcgtcgtgagcctgggctgaaacactgcctcatgatatgtgcactgatgattgtcagccgttggctgatgtagcttcggtgccgttgacctggttaaagccctgttcctaaaatgtggacatctatccatagcttatggtatcataatgtcataataataataaggactacagagatgactctgtgtctgctaactgagctaaacagacacattcaagaattacgacttcgtcacaagtccatccgccaacgaggttatcaaacaagcactggtcgaatacctgaaggccaaacgctcgcaccgacatggtacgaggcgccttcgaaagagtgcttcaacagaacaccgttacgttagagaagttggaacacttccgatgacaatgtggtcgactactgacgacgcggagcaatccaatgcatggtttgtcggccctgatatgctgcgggatgtcggcctcctggaggctgcgactccaggttactacgttcggtaacgacatatatccgatgctgcacgagaaagcggccgtgttgctgcacagcttgcttcagaaccatccgttcatcgacggggcgtgccgcccccactctttgggatcttacggtacatcgcctctaccgatatcagcaaacgtgatcatgatcagcgctacgatcaggtagacgctcagcatcatcgacacccccaccagcgtggacggactggcagtcaccacggcagccaagtgccgatccgtccagtttccatgcaaacagcgcgattcaaaatcgcaccgcgtgcctgctcataaccttagctcggtgtcgacttcgatcggaagcacaagaaagataaccagcactctggactcggacttccggaacttgccgaacgccctccgtgatatcctaatgccgaatagttcgagcatataaacatatgctcgagccgtccagtgagcgcgctagtctagctccatcgctctgcgaggatgcagactttaattgcaagaacactaaatgatccccggtaggatcaaaccagtcagggatagcgagactgtgattcgcgacggtttagcacttcgaatatgtctcgaataactccgttccccaaaaaacgtcgttgacgactagcaacttccttggccttaccgccgagcagcatctagtgtgcagccgatccacgccggccagttaacaaggaagtacaacgtaatcacgacgaaccacgacaacagaatgagtcagagttgggtgtgttcgctgcgatcgaacgccatacgcagcagaacccacgatgccgacgagaggaagtatggaaaaccctgagaataaacacattttgacccgaagcttatccggagacatcccggctgcgaagaacaatttgggacaacgtaatcaatatgtaaacgcataaggtaatcaatatgtaaacgcataagacgatggcgctgacgagtcgaagagtaaggcgacaccgtaccggcgcgagccaagccatcacgatgcagccgatacctaccaccaacgagcacaaaatcgctacgtacgctaacccacgccggctgagcttgacccagttgggccggtgcccttcgggctgaccgtctagcacgaataacatgcgcgacgctgtgtatatgcccgaagttcgggtaaaaaggagtatggcggtgagcgccaccgcattcatgattttatccgcaccgaaaatatgtatccactttaacacaaccacttagggtgaggcaccgacttgcacagaatcccacggcaacagcacaaccagcagaaagactgaaccgatgaaaaacaccacgatacgagcgaccacggtgttggtcgcgtactgtaccgcgcactcagagttggaggtttcgacggcggcgatggtagctaatttccgcgccgaccatggaggagatcgcgacccacgatgacggcacaaacaaacggcccccacaccattcgggaaaaatccgccatgctaaccgaggttggacaaatccagttgacaatgtggccacagcccgaggacgaacaatgttccgacacccagaaaaaccacaatgatagcgactttgattccagcgaaaagacattcgaactccccgtaggatgcgacggagaacagattggtcacggatcatgaccatcaggattagtgcaggcagccacaacggcgtatggagccagtaagtgatgacctacccgccagcgacagccgcgaatccgaccacaattacccataagtaccggtacagcgagccaaccgagaagccagcccagccaccaaaggcttgtcccacaagagtcggcgaacgatcccgtgcaaaggttcgcggcaaccatctcgccgagcatacgcatcacgagaatgctcaacacatcgcaaaccgcgtaagtcaggaacgcagcggagccagccgcgtggattaccacgccagaaccgccaaacaacccggagccaatccgccgccgatggcgatcatgttgagctaacgctgcgacaggccttggcgcagctcttatggagttacccatggcttgccatttcatgggtcctcctgacgcgccccgtcccctaatgttggtctctaaccacaacagacatcagggggcggagcaccactcggtggcatacggcatacggtgtggggctatcgaaaccagcgggatcggatcctggtgattgcacgggatggtgtggtccgaacccttgaagtccaaacatcccgtccagtacaccagcacgcccgttgaacgaacgagtgatcaccaatgcggccggtgttcccaattgtcttcgatgaaccgagtgattgaactttggccagttagcgtgtggtccacaaaacttactttggtacataacgctatgatcagcagcggtagccgcgtgccagaccagcatcgtccttggtgaacgatgaagcatgccggcccggatctcagcatttgtctgggccgtccagagcgtcttcagctgtggcggaagcggcttacacgaccagagggggctggtggtcgtataagccgtctgaatcgtcataggctatgatgatggccatatcccaccatttcgggtgcttccgcagatggttgaccatattaacgagaaactgttgttcgtcgagcggaccggagtaaccggcgtgcatatcttggtagcctagcggtttcagaatgctcatcgctggcaggtcgcccacatcgacgggtgcccaaaaatccgataggctgtattttggtggatggccgtatcggtgaagctgaccttgccggtcgcgctcggcggcagatggtccaggtttgccgtggatgagtagtactgaaacagctcgtggtagaccaggtagtcagctctagtttcgaacggcaaagctccagtcttgccggtgccacccaagaccgtactcatgttgtgcgttgcaccgcattccaccggcaacgtcgggcttgcggccgctgggtttgaaatcgcttttgtttgaaaccgccttgaaacttgaaaaatagtctcggtgaagcctttcgcattgagcagttcaccaatgtttttggcgtcagcgctgaactgcacctgctcccgttaggaacaatcgtcacctaacgattagggatcttcgatcaaagtgttttgtccgttgcttgcaacgtcaatgactatacgaggccggaacggttccctataacagtgtgagtgaatatggttattgttctataagtgtaacccgacaccaagttgatgcggcttggcgtagaagggccgaagatggtaccggtggaagttgtccctcattgagtaccctcgggcgtagttccacagcagagtaaccgagttggcgtcgtagtttaaggacatcaccaagccaagaactccaaagaacagcggtgcacatgggtcaccctcgtcgtgttcaacacgccgatccatggcaccaccatgggcagacatgtagctcggtttggtattcgtactgctgatcgcaggtcagctgctgacccggtccgctcaaacgcatcggctgcaccaagttgggattgtgcgtcaacaaatctggcgttagaccgttgaccgtaagagtgtatggtttggccatgcaaggttggctatcgatgttggcgacataatgactaggttccgaagtagtggtcaaatgtagatgttctattggaagatgaccactcgatggtgtattggggtcgcagttaccggtcccgcactcggggtcttggatctgtgagagcacgccgcgacaagagcaaccaccgcggccgctgcttaggaaaccgcacacccgttgggcaggacgcgttgcgaaaacacgaattcaagtgaccgttgggctgcaatgacatttagcagacccatacccaaccttatgggccttaaaggcacccattaggttaacggcataggaacggaccgcctatcaggagtcgaactgttttatcactgtctctacagaccctgaaatgctaggtagatctacattgctctcggatgtagcgtagctcgaccagcaaagcgcccggccgtcgcggcattatgacgcccgtcgcctaaacacacgccgtggtggtcgactgccagcgccaggacaagcgctgcagtggtgttgcgtgcactttgtgcgccatcctggatacacgcgaaccgcaagctgcgccgcaacccctggcactcaccccgtttcagacctttacggcaggtaacatcgtaccgaccaggctcaccagctcgttcatctcaacgggtcgcgacggcgtcaagaccaactgggttgtcgcttcgcggccgggcaagaccgggatgctgcgtacagtgattgtgttgcacggcaagagtggcaacgcagacatgatgcccgaagcgtgcttggagggcgcactcacccaactagccaaggcgggccgacaccattccccgaggtaggcgtcgatggtgatgatacctactggcaccgacgtgcatctggcgtggactccgacgctatggtacttgaaaagcatcctgacgatgcgctgtcctcaatggatatggggcacttcctgggctggtagataggcgaatacagggcgctgctgctgagcacccggccggggccatcgcgaactgcagggatctgcgcgatcaccccggcattgtttacctcattcaccgatcgcatccccggcgcgtttgacagctacgacgattgggtacaacacagcgtagtagggtctcctggcactttcgtagctcccgctgtgggtggactgcgcaccagcgaccacctcatatttctatttcgccacctgccaattcgtcaaccaactgaactctccactgaagtggattttccccaggagagcaagatatttcgtattgccgaaagcagctacccggcaagttggaccagctggcctcctagcggaagtggacagacaacgaattcatgacagacacagtaagaaaataccgtccgtcctcgccgccgagcaaagttgcgtggattccacccggacatcgagggcttgcgtgccgtcgcggtgttcgcggtgctatgctacctagccaggctaggaaacggtaacgaccggtgcgatgaggttactaccccgatctaattgacctgttctgcacccccgacagctgcccgatgatcgtcggcagtaccttggtgtcccggtacgacaactatgtgacacccccaagcacgcgcagttgctggcactcgccatcgacgcggtagccgatcgcgccctggccgaaggctgaggccaatcaacacgttagcgaatatggtcaagctgctgcggtgaacttcttgctaaagccactcgtcctatatatttcctattactgaaaggtttgagtagatttgagatgacgatgttgctggtctgcctgtctactggccgggcttggccttgtgctgctgcaggagcggctggaacgctagacttactagtggagaacgcgcaaaaataacaagtattgcgctacttaacttttcacctcacttttggagagcagtcagacactgatatggccacgccaccccgacaaccgccaggatcccggcgagcgttcccaacaacaaggtttacgttcccaacaacaaggtttagtagtagctgctgaggataatgcacaccaacattgtgatcggttgcccgtctacgacgggcaaccgatcacaatgtaacgcgagcgcaaccacctcacctcagctcccacaaacatgagaaaaggccaaaccgaattcgatcatcgttcgataacgaccgttcaccgcggtgacgcgttgttgtcactaccgacttcggtgacacatccgatcaggcgggctccacacgctcctgaaccagcggagttagcactgcccgaggatgaacgaccaggcctgcgcgatgcgctcctagttgagcttcagtccgatgccaacgcagccgtgcagcaccccgaccaatgcgccaagcgccgaccgccacagctacaacttcttatcgaacgccggtaaattctttcttattgaacgccggtaaattctcgatttccggataggatcttcacgatttcggcaacaaggatcgtctcgacgccccgacacagggcaccgtaggtcggttcgactgaagactggatttgcgccggcttcacctggaggcctacaaaccaagacaccagaaccagaaaaatcaacaggaccaccagctgcatcggagcaccactcccaaaatgccaatgaaaatcacggccgccgctgccgctggtaccgatccagttggcgccggactcataaaacaaaggcttgcgattggcctccgtttttgccgtcatctacagccccatctcgtgattgtggcctatagactcgtcaagaaagccaacacgccacatcagcggcccaataggtgaacacgatatccgccccagcgcgccggatacttgtcaacgactccagcacagcggcacgttcgtcaatccagttgtttgcggccgcagcgcaaatcatcgcgtactcccccgagacttgataggcagctaccggaaccggcgaaacaccggctgccgtagcaacgacgtccagataccccgaagcgggtttgatcatgataatgtctgcaccctcgtcgagatccaacttgatttcgcgcaacgcctcgcgggcattgcctggttcctgctggtaggtgcgtcggtcaccggacaagctgcagctcaccgcctcgcggaatggtccgtagaacgccgaagaaaacttcgcagcgtaagccaggatcgctacgtcggcatagcctgcactgtcaagtccgtctcggagcgcacctatttggccgtccatcatcccgctcggaccaaccacgttagcaccggattccgcttgtgccacagcaagttccacataccgtgccacggtggcgtcgttgtccactcggccctgcccgtctaggacgccgcagtgcccgtggtcggtaaactcgtccagacaggtgtcggccatcaacacggtggcatcaccgagatcctcggccagatcgcgaagagcgacattgaggatgccatcgggatctaccccagccgagccagttgcatccttatcctggtcgcggggcacgccaaacaggttcaatccacctaccccggcatcgacggcagcgacagcagcgcgacgcagcgaatcccgggtgtgctgcacaacacccggcatggaagcaattggccgcagctcgtcaataccgtcagcaacgaacatcggcagcaccaaattccttggctccagagaagtctgcgccaccaggcggcgcatcgcgggggttgagcgaagccggcgcggccggtgccgcgggtaaccactgacgctcactgactgcctactgccgcgcccgtcctaaccgtgctcacgatcactactagcgcctgcggctcttcttgcgcggtggaggcagcgcgccttcggcgcgcagtcgagcgacatgttcggccaacgcatcaactaacggtccaaccgcggcggtttcgggctggacatccacccgcaaaccaaattcggaagcggtctcagcagtcttgggtccgatgcaggcaatgaccgtccgcgcgtgcggtttgccggcaataccaaccaagttacgcaccgtggagctggaggtgaagcacactgcatcgaagccacccgtcttgatcatttcccgggtggccccgcggcggctgccgcccgcaccgtccgataagcggtgacgtcctcgatctcccagccacacccgcgcagtccctcagccagggtttcggtggcaatgtcagcgcgcggcagcaaaacacggttcaccgggtcgaaaacgctgtcataaggcgggaattcgtccagtagaccgagggaagactgttccccagccggcaccagctccgggctgatcccgaatgcacggaccctgtcggcagtcgcttctccgacacaggcgatcttcaccccggagaaggcgcgggcatccagaccgaactcgccaaacttctcccacaccgcgcgcaccgcgttggtggaggtgaacaccacccattggaaacgaccgtcgaccagccccttgacagcacgttccatctgagcgggactgcgcggcggctcgacagcgatggtcggcacctcaaccggcaacgcaccgtacgacgtcagccgctcgctcatctcgccggcctggtccttggtacgcggtaccaacacggtccagccgtagagtgcacggctttcccaccagttcagtctagctcgactggtcaccgtcttgcctatggtcaccaccagcggcccggtcagcgggcctgcggtatcggtgccgaccaggacagccgagtcagccaatccctccaatgtggtttcgacagaacgttgctggcaggtcgtgccctgagcggtcaccacgcagggtgtggcgtcgtccagcccgtggtcgatcaagatgtgcgccgcgtcggcaagatgtgatgcggtggcttgcagaatcaacggcccaggagccgcggctagcgcttcccagtccacgtcgccacgtacatcagccaccgtgtgcgacgaacccaagggtagcccggcataggttggtacgacgctgctggtgaccaagccgggcacgatctcgatttgtagattggtgcgtgccacagcgttcacctcggctatgaccgcgtccaccgtcaacggatcacccgccactaagcgcaccacatcaacaccggaacgagcctcggcggtcagcgttttggcgacctcagtagggtcacccaacgcagggcggatgtcggcgcctccggacatgaccatcggtgcggcttggtagtgatccccctcgagggtaccgtcagcagccctgccggcggtcacggcagccggaccggcaggcgccggaccagagaccggtggcaagtccttgccaatcagcgccagcaccggttcaggtacatcggggtcgataaaaacaagggcggcgtttgctagcaccgctacagcctgagcagttagtaaccctggggctcctggaccggcgcccacaaatgtgatgcgacctggtctaagcttacgccctcgcgtcgtcattgtcgctcccaccactcccgttcaacttcctcgcgcccggtctgaccgcgctccccacatcagctcccgggcacccagctcaaacagctccacggcaactgctagcccaagctcgctcgcccgaccggacgtgctgatgccggacgcgcggatcacgtcggatccgtccaacgccgccacgcagccgcgcaacgacaactcttcgaagacgcggccttccccatcgatggactcgaccacttgagcgatcgcgcccaccggtgcggagcagccggcctccagttcggcgagcaggactcgctccgcggtgaccgccgcacgtgtgtcggcatcgtccaacgccgccagcaccgccaccaaccgactgtcaccagcgcggcattcgaccgcgatcgcgccttgagccggtgctggcaccatctgcaccggatctaacgtctcggtgacttcatcgaggcgcccmcgggccaacccggcccgggccaccacgatggcgtcaagatcgccactgcttaccctgttcaacctggtatctaggttgcctcgtagggggcgaatttccaaaccgagacccaatgccctaagctgagctgcccgccgcggcgatgacgtgcctaccagcgatccagccggcaattcagcaagaaccagctcatcgcgagttaccactgcgtcgcgggggtcatttcgtggaggaatcgccgctaccgtgaaccgcggatcgtcagcagttggcaaatccttgtacgagtgcaccgcagcatcgacgcagccctcttcgatagccgcacgcaatgcggtggtgaagacgcccacacctagactgtcgatagacgcagacgactgatcgcccgcggtattgacgatcaccaactccgcaggatgcccgttggctatgagagcgtctctaacgagcgcagcctgagtggtggctaacaagctaccccgagtgcctatccggatcacgtgggccaatcaactactcggcgtgatattttgagctgctctgggcagggcttgtgccgtacctagtggtatcgctgaacccacttaccatcactggtaattcacccgcggtggcgaccgcgtcgacagcggtctgatcaagctcgaaaagctcacgcagcgcctcggtgtagctgtcaccgccgggagcactggcaagctgcttgatccgcacggtaggcgcgtgtagcagcttgtccaccacccgtcgcacggtgcgtgccacctcctcgcgctgagcgctttccagccctggcagccggtggtctaggcgcagtaactccgcttcgaccacatcggcagctcgctgacgcaacgctgtcaccgtcggggccacctcggccatccgctgcctagtcagatatgtggccacttcagccgccacaatgcggcgcgcggcatcgacgtcggcggcactggcacgggccgacggttcacgctgcacgccttccacatcgacgacccaaacgccgggcagtttggccacagccggatccacgtcacgcggcatgcccaaatcgcatatcaccagcggccgagtcgtttcgtcacggcgcatagcggccaatgcatgatgcacgtcagccagcgaaaccacggggcttaccgcccccgtacagctgaccactaggtcagcgtccgccaatgcttcgtcaaggtgattaagagtccacacgtcggccggcacgcccgattcaccgatcttgccggccagccgccgcgctcgagacaacgaccggttgagtacatgtatacgtccgacgttggcctgcgtcaggtacgacgacgagagtgcacccatcgcgccagcgccaatcaccaccgcgatccggcccgccagcccgcccaatgtgcgtccagctatgccaagggcgaccgacaccaccgagaccccggcagcgtcaatggcagtttcggaatgcacccgcttacccaccgacaacgctcgttgggccacctcatgcaacacctggcctaccgtgcgattagcctcagcggcggcatacgcgcgacgcacctgacccagcacctgctgctcgccgaccaccgctgaatccagaccgctggcaaccgtgaacaagtgctcgacagcagcctcgctgtagcgtacataagcgtatttggtcaggtccccgatcgacatcgcggagtattccgacagcacttgcccaatcactgataatcccgcgtggaacgcttccaccacggcgtaaacctcgacacggttacaggtcgacagcaccatcgcctcggtcaccagcggggactgcagcacccggtcgacgatcttgatctgatcggatctgtccaggctgagttgttctaagacagagaccggcgcactgcggtgcgaaaccccgaagagcaagatgctcacggcagcatcacttggccagctcccttgctttcctccagtagtcaggctggtgtctacggtagacgttgatcaagtgggctaccaaatattgtcagcggatgaagatccacgcagacctggacctcgtcgacttcccagtagctgtactagctgccatcaagcaggatcaccggaagacggttgccgaactccacccatagcccaggggtgccctctagcgctgcagcgtcgacatccgtcatcgtaaaatctaagcccagctcattagccaattcaatcagctagatgtgtaccgcgcgcagatcgcgcacccgccgcaggttggcagctcaacctgcgaccgacctagcgcctcggtcatggccaccagtgtggcagccgttatcgaaaggcgttcctagtgaaagagtgtcccagcccagttctcactagattgccgctgtggctcctccggacaacctagtgtcgatcccgtggtgctgcagaggttcgcccaaattctacgcagtaacacccgcggatgtgatgtagcgccgcggcgggagcgggcctgtctatgttagcgcagctgacaaccgaagccgacgacggttaccaaaagaacaatacgacatcggcgcaggcactgcgagaagctgacaatggctgaagcgtttctcgtcggatcccgacgcgatggtctgatgtagtggatcagtatagccaagtttcaacgccatgcaaaaagcatgctagccgaaatcgactctctggtggccagtctgcatacaatgtggttaggactaaggtgcagcggccacatggccgaggcgcatctgcactaagcgcacagcgaggagctgatatgcaacgcgttagcgcagttacaggacgcttgagagactactcaccacaactaccctgacgccatgtcaacgaatttgatgatgcggtcgtgaaccgatggaccgctagccataacctctgcgacccgagttacaatctagtcgctgactcaccgactagatacgtaaacctccgcaacccaatttcccagatagggttgatgtcggccactgaaccgaccaccgggcaagcgcagcgatttaggaggtttcgcgatggcttcccctgacctgagtaacgcatataacggtcgcattgacctgggttccctggccaacaacgcgagcatcaaccgggcgcttaacgatatgcccacagcagtggacgacgcaggggtccgcccgcaaccaccgatcgacctgaccgcagcagcattttttgacgtcgacaacacgctggtgcagggctcgtcggcggtgcacttcggtcgcgggctggccgctcgcgactatttcacctatcgcgatgtactcggattcatctacgcccaggctaaatttcaattactcggaaaagaaaatagccaggacgtggcagccggccagcgcaaagcgctcgcgttcatcgaaggacgatcagtcgagcagctggtagctctgggcgaggagatctacgatgagatcatcgctgataaaatctgggctggcacccgccagctcacccagatacaccttgatgccggccagcaggtgtggctgatcactgccacgccatacgaactcgctgccaccatcgcacgtcggctcggcctgaccggggcattgggaacagtcgccgagtcggtagacgggatattcactggcagactggtagatgagctcctgcatggagtcgggaaagcacatgcagtccgatcgctggcgatccgggagggcctcaatctgaagcgctgcaccgcctattccgacagctacaacgacgtgcccatgctgtcgttggtgggcaccgcggtcgccatcaacccggacgcccagctacgcagtctggcccgtgaacggggctgggagatccgcgactttcgaaccgctcgcaaggctgcccggatcggggtgccgtcggccttggcgttgggcggcgcgttggcagcggccgtgtcgcgtcgccgcgaccgcgaataacccgcgagaagcacaacgacctcaccgaacccaagcatcgcaacgccaatcatgctgataaactgcggcgttaagcccagagttgagcggagagcgcagcgtcatgacagttcccttagaggccgaaggactaatcggcaagcattaccggcagttggatcacttccaagttggacgcgagaaaatccgtgagttcgcgatcgcggttaaagacgaccacccaacccactacaacgaaactgcagccttcgaggccggataccctgcactagtggctccgctaaccttcctggcgatcgctgggcgacgcgtgcagctcgagatttttactaaattcaacatcccgatcaatgtcgcccgggttttccatcgcgaccaaaaatttcgcttctaccgcacgatcctggcacaggataagctctacttcgacacctacctcgactcggtgatcgagtcacatggcactgtgatcgcagaagtccgcagcgaggtcaccgatacggagggcaaggcggtcgtcaccagtattgtcactatgctgggcgaattggcccgtcaggatgctaccgctgaagaaaccgtcgctgcaatcgcttctatatgaaaggcgaatcatggttccgtcacagagccatccggccaaaacccctcgtaaacagctgaaaccaccgatcgaagccgtacagtcgcattacgaccgatcgaatgagttcttcaagctgtggctcgatccatcgatgacctacagctgcgcatactttgaacgccccgacctgacgctggaagaggcccagcgcgctaagcgtgacctcgccttgagcaagcttgggctagaacccggtatgactctgctcgacatcggctgcggctggggatcgaccatgctgcacgcgatcgaaaagtacgacgttaatgtgattggcttgacgctgagcgcgaatcagctcgcccacaacaagctgaagtttgccgaaatagaccacacccgaacagaccggaccaaggacgtacggctgcaaggctgggaacaattcgacgaaccggtcgaccgcatcatctcactcggcgcgttcgagcattttgctgatggcgcaggcgacgccggattcgaacgctacgacagcttcttcaagatgtgctacgacgtgctgcccgacgatggcaggatgctgctgcacacaatcatcgtgcctgatgccaaggaaaccaaggagctgggcttgacgacgccgatgagcctgctccgcttcatcaagttcatcttgaccgagatcttccctggcggtcggctgccgaagatctcgcaggtcgaccactattcatccaacgctggtttcacggtcgagcggtaccatcggatcgggtcccactatgtcccgacgctgaacgcctgggccgcagcgctggaagctcacaaggacgaggccatcgcactgcaggggcggcaaatctacgacacctacatgcactacctgacggggtgttcagacctattccgcgaccgttacaccgacgtctgccagttcaccttggtcaagtagctacgcgacatacaatcgcggcacatgcttagccgaagaagatgttccggcgaccagcgagcaacctataaagcgtctgctggatcgtctcacgcacctgatcggtcagctcgaaggtgaccattgggtcatcggcgtcggtggcagcatagtcggtggtgtaaattggctccccgaatgcaatgcgccatttcgacggcaacggcaccaaacccgccggtccagccaacgggaacagcggcgtaaccgggaaatacggcacgccgaacagccgcgccaacagcttgacatcagtcagcatcgggtaaatctcttccgagccgacaatcgagcacggcacaatcgtcgccttggtgcttaacgccgcctttacgaagccgccacgaccaaacctctgcaaccgataacggtcctggaagcgcttgcccagacccttgtagccctccggaaatacggcagtgagctcaccggcggcgagcaagcggtgtgcgtcggatgtgcaagccacggtgtgccctgccttacgtacggcttcaccgaccactggcaagtcgaacaccatgtcggctactaacagccgcaagtcccgttgcgctggatgctcgtcgtgcaccgccaacgacagcatcaatccgtcgaacggcagcacaccggcatgattggccaccacgagcgccccaccggtgctcggcaagttttcgataccgctaacttcgactcggaaccatgacttgaagaaaaaccggaggaaaggccgaatgatcgcgttgttgaagtgcggatcgaacccaaattcgtcgaccgtgtagtcgccggtcaaccgctgccgaaggaaccctgcaacagcggcaacatgctgggcaagctcactaagtggtgcttcagtggttacctcccataaattggtcgcacccgtggaacgccgatgttcatcgatttcgcggacgactgccgcgatctgctcagctgatgcgcgaccgcgtagatcagaaagtaacgagggatgttgacgagacccgtcgacccgataaccggctctccgacgtgatgctacccgacccctcttgatatgcaacggaataacattcgctctggtttcgcccaccacagtatctacctgaccccaccccacggaattcaatttcggctactccagcgctgcgctaacgctatggcgcgaccctcgaagtagcgtacccgatgtaggtcaattatgggagtcaaacctcggccgcgaacgtagtcatcgaacgccccggccgtcgtccacttcgggtgataaccgagttcggaacccatcctggtggtgtccatgacccgaccatagctcaggtactcaaactgatctcgagtgatttcggtgtagcgattcacccaccttagcaaatcaagtgcccagacgccgaagctgggtatcggcaccgcgatccggccagcccgccgaatagcttgcgaaagcatcataatgccactggcgccgatgttgaaggtgccagccttgccggtcatcgccgcgcactccagtgcgcccagcgcatcctgttcgtgaagcagctgcagccgtgcatcacggccgcacatcgtcggcaccaacggcccggccagataccgcgacaacgtggtgtccatcgccgggccgatcatgtcagccaaccgcagaatggttaccgcgatatcggaccggcgccggcccagtcccgcgtgcgtaaccctcgatatcgaggctgtccttggcgaaaccctcacggaaagaacgccaactactgctgtcctcggtgaacatcaccggatcgcgggaacccgatccgtaaacggccgaggtcgacttcagcacgacacgacgcacggtgggcgccttctggcaggcggcgaatagttgcatcgcgcccatcacattgagttccttcaacgccgcactaccgcaggagcgcggcgcataggacgctgcgtccgcgtgcacgaccgtatcgacctcgccgttgcgaatcaccttggcgataaagggattacgaatatcggcgcgcacgaactcggcgtgccccatccgacgcagcatgtccttgctgggcgcaatcgcatccaccgcgatgaccgcattgatcaaagggttttgcgccaaccgagcagtcagatagccgccgagaaagcggcaagcaccagtaaccagtactaccttggggtagggcacgactccgcctgttccaccgccatcctgaccgctcgaggaatccacttggtgagcctaaaggccagaagaaacagtggctctacaaccgtatgaaaatcggaacatgtagcggcggctacttgccaagttttctgcgctgcacccgggtgcggcgcagcaacttgcgatgctttttcttggacatacgcttgcgccgttttttgattactgaacccatgaactccgctatcccgtggccggcttggaagaaaacgtcctggtcactgtacccgactggccgggtcgaacaccaaaccagcggccgcgtgaccacgtaccagggcacgctaggtgctcacagtttacattgcccactgtgccccggactcgcttggtactgccttgcgttggtgcgcagctgaactttcgacaatgcgtgccgtgcagcggcgtgagtaggagcaaaggcaatgaccgaggctagcccacgtcgaagtacgacgtctcgagcatgtcgtggacagccttggcatgcacccggaaggaccgcccaacccgaaccgccggcaattcaccgttgtgtaccagccggtacaccgtcatcttggagacccgcattagcgtcgccacctcggccacggtgagaaattgcgtgcggggctgctggccctcgaacgaaccggtgtcccgcaccgatttgccagctgaatcccgcgccgatggcccgttagtagacgtcatcgcaacccaatcgtgtcaggcacgcgcaatgccagcggcttcccctccgctggcacccacacgtgcatacaataaaagaggatagcggtactagtggggttactggtactgatgggggaaatcagttcaaaaatcttgaattattccgatgtaattctgagctgttcagaccggattttagcggcctgaaccgctgcgtcgaccaccatccgcagtccgccacgttcgagttcgcgcagcgcagcggcagtagtaccaccaggcgaggtaatcgtggcgcgtagttgcgccgccgggacatccacctgcgcgcccagaggcgccacctcggctgaatgccgatcttgatccatacgctccagtagcattgccgcggaccccgccatggtctgcgcggccagttcggtagccacctgacgagtcagacccaccgcgacgccggcatccaccagagcttcgaccagcaagaagaaatatgccgggcctgaacccgataccgcggtaaccgcatccatttgcgactcaggaaccgtcagaacgccacccaccgcgtcgaacatggccaaaacatcctcgaactgttgtccagtaacgaaacgccccttggccaacacggtaacccccgcgcccaccaacgcggctgcgttcggcatggcacgaaccaccggcgtaccagccggaagcttggactcgagataggtgatcgtaacaccagcagccacggtgactaacacttgctcagcgctgtcattcgcgactgcggctgcctgaaccaggtcccccatcactgactcaacgtcggtcggcttcacagcgacaacgacaaacattgcgttctcaaccgcgtcggttactgacgtcaccaacaccgagtaagtgtccgctaggtatcgggcgcgatcaggcatccgttcggccaccaccaggtctttgacctgcctccccgcccgcagaagccccgacaacaacgcttcaccaatactgccaccaccgatgatcgcgattcttgccatgctggaaagcatcccagacagctcggctcgaccgtactaccgggcagaagtaccaaacgccaggtagcacaactgcgccacgacacggacaacttggtcgacgacgatgtgatcctggtcgaacccagtactgcccaatctccaagcagatgcagatcacccgcagccagccgtaagtcgtcaagcaccgacaaaaggcggtaagtacgacggctggcgcccagccgattctgcccaagaccaatttgtcaccagcgccgacaaatactccgcacatgagggaggacaacgtgtcgggagctacgccacacgggcgtgcccacatctggatcacagacggccgcccggacgacccgaccctggcgggggccaaatcgccagggtcgggtcgtccgggcgactacaaagacttcgctatcaccagcgacccaatgctctagctcagcgaaattgaccatggcatgcaccactacgcggtttgtcttgggcaagctcgacatcgaacacgctggtccgacaaccacagagaactggccaacaccgcgaccggttgcaatccactcgattcgccgccccatacgctgcgcgcagcgtggcacacagtgccaacatcaccccagctgtacaccttgagccctatatttgggccctatgatccaatgctggttgaactcaccttcgtatacgcctgcatcgacctaccgcagcgtcattgcagtagtgaatagttcgttcatggcggtcatcagaggtctcaattaacaatgaacatcaccgcagcaggtacgtgcgagcgaattgcaacgattcggtcagcatggtttcacgctcagttgccgaacgcacgctggacgtggacacttcgagcaccacgtggccggcgaagtctgcaccggccagcaactggcacaccgcagcggtaggttgcgtgccacggccaggcaccaggtgctcgtcggcgggcaacccgctgccgtcacacaagtgcaggtgcaccagccccgaacccatacgccgcaccatctccagcgagtcggaccccgcggtcgctgtgtgcgacaggtccagggtgtagtgcgcgtgattgccggccaacggatcgaatgagggtgcgaacaccgaaatagccggacccggaccaccaccacgcttgcgcatccgttcccgcgactggtcggccccgaaaaatcggtcagcccgaaacgggaacatattttcgacggcgatcatcacatcgctagctgcttccagctcggccacctggtcgctgaatccctcggcgtaacgtcgttgccaacggaacggcggatgcacgacgaccgtctgtgcacccaattgctcggcggctcgcacactgcgttccagtttgggtactgggttggcaccccacacccgttgcgagatcagcagacagggcgcatgcacagatagcaccggcacgcgatagcgtcgcgacagccccttgacagcatcgatgtcctggctgaccgattcgccccataccatcagttcgaccccgtcgtagccaagcttagccgcatactcgaatgcggcctcggcccttaacgggtacacggaggccgtcgacagaccgactttaatgactgggcgcaaaggtctacggtggtttcgaggagcttgagcctagcccgattgcaaggacaacgctaacggtcccagggtgatcagcgcacccaccacaaccgcgattagcgtactggcgatgtcctcagttctgcgaactacccgcaccccgaccaccaagccgagaatcaccaacaccgataataccagcgccacgatgctgttccaacgccacagctggtcgaaggcaacgaacaacccggcaccgaacaccaccgccagaatcgactgcagcacaatcaagctaccgcgccacagtgcttcgaatctgctttgccagccgcgggcaggcgaggttataccagcaagatcggtatgcaggtcgagatggtcttcgtcgaggtctattccgacagccagcaacccccctgcggcgtgttcatcgccgcgccgttcagctagctcattggtgagggtatgcccgctgaacagagcccccgctgacatttgcaggttgtaacgcgcgtacgctgactcttccgccactaattcagccgcacgcacctcagagcccatcacgtccaccggaatgtcggcgaaaggctccactggatcggggctcatcccctcggcatcggattgcttctgcgcaatgctgtccggagcaaccgggtgccgtacgtcgccgaggtgaggcaacggacgcgagcaagcactccgttgcaatcccgtcctgagatgggttagtggcggcgacttaggccaacgcggctcaggtgcggaccaacagccgggcgggacatggccgtggttcgtcgaccggtggttcagcgacgatgccttcacagaccggttctagcggagattgggcggccggctcgacaacccggactcctatgttcgcccgatgagcatgggtggctgccagatgctgctcgtcagcgtgatcatcatgaatgatcggaatatcgcaggtcaactccgcgaccgtgaccgcgtcgctgtcagtacgccgacgccgacggcggctgaccgcgggagcaccaatggttccattcctagccagcaattcggccaccgagatcggccgggcgtgggggctctcggtgtcgttgtgtggtccggtcatgttttgtcgcctctcgatcggttagctgcgttccgatcaacctcttggcctctagtatcccgcaccgaggtctgcacgagtgcggttccatcggcttcgctgtcgagtttgcgtaagatgaggccttcccgtaatgcccacgggcagatatccaccgtttctatcgacagcgctcgcatacttgcttcggccaccaaagcgcccgctacgatttgcggcgccctctcggtacttatcccttctaattcggcacgatcagacgccgtcatcctagagataaacgcgatgagttgtcgcaggccgttgaccgttagtgcgcgcttcgcccgtggtcccgccgccgacggtgccgcaccagtaagcctagccagcgaacgaaacgtcttcgacgttgctaccgcgagatcgggtttgccggcttccaaaacggtcacgctggcatccgacagctcggaatccagccagtcacgcagcatcgccacccgacgccgaccgggcggatcatctggcaaccactcgcgggttaaccgtccggcaccaagcggcagtgataacgcgacctcgggctcctcatcgacaccgtttgacaactccaacgagccgccgccaatgtcgaggttgatgattcgccccgcgctccacccaaaccaccgccgcaccgccagaaaggtcagtcgcgactcatcgacgccacgtagcacctgcaaccggacaccggtttccttacgcacccgagacagcacgtcgtcggaatttcccgcctcgcgaaccgcggacgtagcgaaggccatcagctcagcgcagccggaactgacagcaatcttagcgaattcgccgattgtggaaactagcttgtcggcagcgcgcttagtgattttacccgagctgtccgtggcttcgaccattcgcaacgtagccttcgtcgaactcattggtgtcggatgtccgccgcgataagcatcaaccacaagcagatgaaccgtgttgctaccaacgtcaagcacgcccaatcgcacagaacaccaacctagccgggcaacgatgctagcgctgcgcgacccactgaggcgccgcggcaaaacaaacaccgacaagcagcgatgcgcgtcgggtgtctccgtgtcaagctgtccagaatctgggtctacctttgaatacgtggcaaactcacacctggaaccggtgcatccaggggaagaggtcgacttggatttcacccgtgagtgggtggagttctacgacccggacaattcggagcagctaatcgcggccgatctcacctggctactgtcacggtggacgtgcgtgttcggcacacctgcgtgcaggggcaccgtggccggtcgaccagatgatggctgctgctcgcacggcgcattcctgtcggacgacgccgaccgaacgcgcttggacgacgcggtaaaaaagctcagccacgacgactggcaattccgcgaaaaaggtttgggccgtaagggttatttggaactcgacgagcatgatggccaatcccaattccggacccgaaaacacaagaacgcttgcattttcctaaaccgacccgggttccctatcggcgctggctgcgcgctgcatagcaaagccctcaagctaggcgtaccgccgcggacgatgaaacccgatatttgttggcaactgccgatccgacacagccaggagtgggtgaccaggcccgacggcaccgaaattctcaaaaccacggtcaccgaatatgaccgccgcagctggggctccggcggcgcggatttacattggtattgcaccggcgatccggccagccatgtcgacagtaagcagctgtgggagagcctggccgacgaactcaccgaactacttggcgcgaaagcctacgctaagctggcggcaatatgtaagcgccgcaacagattaggtatcatcgcagtgcacccggcgacgcaggaggccaaatagcaccaggttggccagcaccgacaacctagcccaatcgcagcggtatgccaccttcttggtacgattcgagcatgcgcagcgcgctggcctataggcatgactcaaccgacgaagcggccgtcgccgcgtcgcgcggcagcacagcctcaggtatggcctgcaagtcaacgaccaccgaggcggggtcggcataggctaccggtgagctcatattcgcgtccaccgaaagtgtgctcgacccaaacgatacaacagccccaacacacagttgcgaatgctttggatgaggaccggaagtaggctaggtaggccacctgacgcgccagggccgtctcggccccacacattccggccagcgcgacgcacaatgcctcgacatcatcgaatgtgctccggtcggagaccaggcagccgatcagagaacctaaggcagcgcgaatttcaaacagctcgatcaggaactcggaacccaatttccgcaccaacacctcgacgaccgcgggatattagggccgtcagatcgcataccacgctgccgttcccatttccggcctcgctaagtacccatctactgcatccgggcacgagtccgccggcaagaacatgccgttaacactgagcttgttcagctcactcccgctcaggctgcaggatctagctcggcgggaaagcgccgtcgaggatggcatcggccaatcgacacagagatttgcttagccacacggtaacaatcagacggctgaatcagccttgattggttcattaactccatcaattaaagtaaatagacctaatgagatcgccaaaacacaactgcacatccaggcgacacaacccgctgagcgtagcgtccgctcggcgactagtcgaccagaggtggagtagtggacgaccacctgagatccacccgcagccccaacactggcagggtcaagccgagcgcctagaagacctggtagccaccctgtcggattcgctgacttgcggccagcttgtggacccactacgagactttcgcagcgcggcactgctcgatcacggcccagctccaacacgggccgagcggttcggccctgaaaccatccaaacacccgctaccggcatgacgtggttcgacgcggcgagcgtgcagacggcgcgggatgtgttgaccgaacacgcaatcactcgtatggggtctgtcctggaagaaacccagttcgctgaccggtcggcgacaccacccactgtgtcgacagatggggcggtagcaccgtctacggcgatcacaatcgcgttagctcgcttcctgtattgacgtattaataattgcccggcaagccctttctcgtagcttcggatacggaccacattcggtctgcgacactgacactggtaactggactactggagggaggcattggcacccgcgcgccatgctcatccgtgtagaccagcccaccgaccgaggcctgagcctgtgggagacacggatacggacgaagccgccgcggtttgcactaacacctagcaggccgacagctacatagagatcggagaacggcactgttcggtagctgattcataaccgggcatgccgatgtcaggctatgcgacgtcaaggcaccctagatcaactaaaggatccctttctctttgacccgccgctgctgcttgccgcagaaatactgatcaagcgcgaactgcacaccgaccgtcgtgctggtccgatacggcgtgtaatgaagttgcaaaagttccagcttttctgactcaatagcttggcccccagtaggcaaacggggttttagacgtcaagacaaacaaagcggtatggccgctgcacggtagcggctaagtgcagctttgcgacctacccgttcttcatcaacctaagacgacggctcgggcgcaggaaatgagtcatcttgcttatcgcgctcaggccgcctcgttcggctcgttcggcggcgcgctgctgcccgaggagcgcgttagcccgtcacgggcccggctcgtcacgcgcgttgaccgttacctcacacagctaactgccccggcacgggcgggcggtgcacaccgggcttctctagctgaccgcgacgagccacttgaccaccggccgaccgcggtagcgacttgaccccggccagcaagatcaggttactgcagcgagtcaccgcgctgaacccggatgccagtgcgccatcgaagtgatgaaggtgatcgtgttgctggccaacgacgcatacgccttgcgcaggaatttgttcgctcgcgcccacgacacatgacgcggctcgcaccgacaccgccttgaccgtcacccaatcaagtgacagagcttccgtcattaccgccgactggtgatcgtcgagtacggcgccggcggcgccatgatggctcacaccttggcgcaagccggcttaagaaccgttatcgtactcgaagagggtcgtcgctgggcggtcgacgagttacgtaccagccacctaattgaccttaaaccggcctataccaccgctcccggtgggccaccatcgcgatcgcgttggtacgaccgtcgttgttgatggcgatcggcccacgtagtcggtggcactactgtcacgaactccggctaccggccttcctgcccacagccggctgtgcaactacactggcgctatgcattcggtctttgtctggccgatccggagcagctgaccgaacacctccaaatcgttggattagcaagcgatgcccattttgtacaacgcatccagctgtgcagacaactgccaatgcacaatcggatgcccacgcaacgctaaattcggtgtaaacctcaatgcattaccccaggcgtgtacggccgacggacggagtgcaaacccaccgacacggcagcactgcgcccgatttgttagtggaaaccgtcatcatcaccgccggcgccatcgaaacacccggtgctgttgcggagcagcagtcatggcgtgcacccgcggctcgaccgaaaactcgcgctgcatccggccaccatgctggtcgggcgcttcgacggggatgttgtcgcgtgtcgcagcgtgctgcaaagcgccgacgtacacaaatttcacgagtcagctggcgtgttgattgaagccatcgctacgccgcagggcatggggttgatgggtcttctccggctacagcaccaaactgctcaactagctggatcgggcatcgcacgtcgcaacgtttggcgcgatggtgaccgatcgcagcgttggctcggttctgtcggtgcatagtgaagcgatggtgcaccaccaccttgcccaagctgacaacaccaagctgctcatcacaatagctgctatcaaccggctgcgcagcatcgaaggtgtgggttgctgacgtggagattgagcgcacccgtgatgcctagaggtgaaccgcagctatcgatcatgacgctggctgtggctgacgaggtggtcacagtgcggtgcacaggctaactctccagtttgtagcccagacctcgcactgtcaccagatgtaccgggttagcgggatcggcctcgatcttggagcgcagccgcttgacgtggacatcgagggtcttggtatcgccgacgtaatccacaccccagacccggtcaatcagctgccctcgggttagcacccgcccgctattgcgcatcaggtactccagcagatcgaattccttaagaggcagggtgatggcatagccgttcaccgagaccacatgccgctcaacatccatccggagcggcccggactccagcacaccatcgctaatttcggagtcgtcatcaccgccacgccgcagcaccgcccggatccgggcgatcaattcacgcgccgaatagggtttcgtaacatagtcgtcggcgcccagctcgaggccgaccactttgtcaatctcactgtctcgagcagtcaccatgatcaccggcacactggaacgaacacgcagctgcttatacacatcagtgccagacatccccggcagcatcaagtccagcagcacgatgtccgccccggagcgatcgaactccgctagtgccgctggcccatcggtcaccaccgtgggctcaaaacctccttgcggaggagaaacgccagtggatcagccagcgattcctcgtcctccacaatcaggacacttatcattcacattccctctcgtcacttcgctctgcatcatcgcctgcgcgggtgtcatcgacttaaactcttcttcctctcgttgcggcctattgagccacatatcgcagccccggggttgcccggattgctcatcgttgtcctggtaaagcggcatggccgccggaatagacagggtgaacgtagatccggttcccggcttgctccacacaccgatactgccattgtggttggcggcaacgtgtttgacgatggccagccccagcccgctgccaccggtagcccgcgagcgcgccttgtctccgcggaagaagcgttcgaagacccgctcctgatcttcaagagcgatgccaatgccgcggtcggtgacggcgatctcgatattgtcgccacgacggcgacggctgatcgacaccagcgaaccacccggcgagtaggcaatcgcgttggacaccagattggctagcgcggtaaccagtagagtttggtcgcccaatacccgcaaaccgctaggcggatcggtgcgaacctcgatagcagcggtgtcggcggccaccttatggcgcgcaatcgcctcggacacgatgatatcgacgtcaatgtccgttacgttaggcagccgctcggcgccctgcagccgggacaactctatgagctcagcaaccatgtatcctaatcgattggcctcgatgagcaccttctcggcgaaccggctcacggtttcggcgtcatccgccgatgccagcagagcctcagctagcaaggccatggcgccgaccggggtcttgagctcgtggctaacattggctacgaagtcacgcctagccgcctccatgcgcacatagtcggactggtcgtggacgaagaccacggcgaaccggcggtctttctcacttagcagtcgagcgtggccgtgcaccgataacccagaccggcccgcagccgggcgttttccgggcaacaggtcaaattcgacatcgtcaccgcccagcgcctgctgtgctgcccgccaggcctggtcatcgagctgccggtcgcgcacgagtcctagctccttggcctgttcgttgaggtaaactacatcacgataggtatcaaccaccgcagcacctagcggcatcaacgcgatgatgcgttgcagcatctgcaaaacagtgatgcccgcccattcgttagccagtctttgccggcgttcgattagtcgcggcgacagccggattcctgccacaataccaacaacaaacgccaacccggacaataccccggccaacaacagagccgagaacacagtcacataaaaaatcttacaaatccttcattaacgccgccccagcggtgcgagaccaaaatcggaaaagtcacactttgcgttacaggtgttcagctgttgttcacgggatgtttgacacatgggatcttgaagcgtcaacaggcactgcaacaaatgtttttacgggcgcgcttgactgattaccgcagcggccgcctcggggtcgaggtaggtaccaccgggtaccaccggacgcagatcggcatctagatcatagcgcagcggaatgccagtcggaacgttaagcccgacgacctcgtcgtcggacatctcgtctaggtgtttgaccagcgcgcgcagcgagttgccgtgcgccacaatgagcaccgttctgccggtccgcagatcggggactatcacgtcggtgaaatacggcaggaagcgggtcaccacatcagccaggcattcggtcagcggcccgccgccaatgtcggtgtagcgagggtcagcatcctggctgaactcgctacccttctcgatcggtggtggcggagtgtcgtagctgcggcgccaagccatgaatcgttcttcgccgtagcgggccttggtcacggccttgtccagaccctgaagcgcgccgtagtgacgttcattgagccgccagctgcgacggaccggaatccatagccagtcggcggtgtctaacgccagatgcgcagtggtgatagcgcggcgcaacagcgacgtgtacaacacgtcgggcaacagattgtgctcggcaagcaactcaccgctgcggaccgcctccgctcgacccttgtcggttagcccgacgtccacccaaccggtgaacagattccgggcattccagtcactctcgccatgacggagtagaatcagcgtagcagtgttaccctgttgcatcggcttagcatttcacggacgagcgtagatggaagcgtcgccgtcaccttcgtcgtcgattaggtgcgcgaaggcctgcagattgttcagcgactcgccgcgagagattcgccagtcccactccttttggatcgacgaacgaaaacccaattccaacaacgtattaaagtccgattccaccgcctcgagtacctgtccgagcactcgatcgatctcgtcggtgtcgaccgacgccaaggacatccggcccaccagatagatatcgcccacgttgtccagcgtgtaggaaacgcaaaagagccgacggttgcgcttgagcaaaaaccggtagacaccctcgtggttctcgtcaggtttgcggcatacgaacgcctcaacatgcactgaatgctcgccgatactcaggatggcgttggtcttgagcctacgctcaccaggcagttccactaccaatcgcaacaatccatcgggcaccccagaaaattccgagtaggtgaggtggctggcttgcagcgcgtgctcaatcaccgaacacgcgtgccacaccgtatcccaggctgtgctcattggcgccccgctcccctgcaagcaggagatgcccctgcctcatggcttcgttctgcatcgtcgccggtacgggtcatgcgcccatcccacggcgtgagatccaacgacggggcttgcgcgttgccaccaagtcgcggacccgatgctgacgcgtcgcggtgaaatcaccgatcgcacgacggtagctggctagcagcgcatcagtggtgttgtcccaggagaattgggccgcatgcacgacagccgcgcgacttatcgcccttgcctgcggcccggcactgagtcgtaacagctgatcgacggcgtccgcccaatgaccgacattatgtccgaacaccaaagtgccggtgaccccgtcccgcaccgctaccggcaagccgccgaccgccgccgctaccaccggagtgccacaagcctgcgcctcgacggcgaccaggccaaacgactctgaataactcggcaccgcaactagatcggcggcttggaagactgtagccaaattcgtacgggattgcggcggcaagaacgtcacccgggccgtgataccaagttcgtcggccaacctaaccagcccgtccggggaggccaaaccactgcctgacggtccgccagccacaacgatgcgcacctgcggcagtttcgcggcggcacgtaacacgatgtcaggtgccttcaacggctggatccgtccgacgaaggccaccacgttgccgtcgagcggcagccccagcgcagcccgagcagcccgccggtcacctggacggaacatgtccagatcaacaccaggatgggccacgtcaattttcgctggatcggcacggtgaatcgaaatcaattgccttgcttcatcatcggtgttgacgatcatccgatcggcctcgtcgacgacctgctgttcgccgacactacgcaacggcggctcagccgcgtcaccatcggccagcgccgcgttcttcaccgcggccaacgtgtgcgcggtatgcaccaacggcaccgcccagcggtcccgggccagccagccgacctgcccagacagccaataatgcgagtggacgatatcgtagtagcccggttcgtgagccgcttctgcgcgcagcaccccggcagcaaacgcacacagctgggtaggtaagtcgtatttatccaggccctcgaacggccctgctacgacgttgcgcactaacactccgggcgctacccacacgatgggcggatcggcagaggcagtggcccgggtaaagatctccacctcaatgccacgccgagccaggtgcaacgcgctctgcagcacgtaaacattcatgccgcctgcgtcgccgatgcccggctgagccagcggtgaggtgtgcaccgccagcaccgcgacccgatggagatcattcactggcggaaacgtttcaattcgatggcccgcacattagtcatctttacaggaccgatctggaaccgcccgaaacgggagttaacagcacgtcaagacccatcaagcagaagactcgtcttgagcaaccgggagttcaggacaccggaacggcgcatcgctgccccggcctcttgtacccggttatcgaaggccgtcacccggatatcacgaggccgtaacaacaaacgtgcagtgaatgccaccaaccacctaggccagcgcctcagggtattcagtgaacacctggctacccgccaccagttcgtcgggattgagcaagtcccgcagtaacgcaaccggcctaatagaacatctaggtctgctccgccggggagatctttaacttactgattgccgacccgggccattcacaggagatcagtaatagcagtagcgacaccgccccccgagcaggcgacgccagataacatgctgggaatgctccttgaccaggcggtccagcagccgaaaccacatcaacgctgacggtggactccaacttcccagtcctgccgagcccacgctgtgcctcccgattgcgttcgaagaccagtcccaggcgtacacgtacagagtggtcgaagcgcgggacaccatggccagcggcgccgtcgacggtaccactgagtctagcatgctgagcaacgcggcggcggcgatgccagcgccgcaagcatcgagaagtgctctaggccaacgaagtcagggtacgactcggctcctggcaccccacggatgctggtggttcgcgcgcctacatggatgcctatcgtcagataaggttcgtggttgatcccggaccgggcactcaagggcgcccgatagccccggagtccaccgggccggactgctcccgcagcacactggcctcaagcagcgcgatggcctgacggttcaccgccgcgatggacaatgatgacaatgatatggcccctacgatgacgttacaaccgaccgggccgcgcaactacacggcacgaaaaacggcagccaccgccaagtcagacaagttcagcgacggaggcacaacctggctatgtaaccgcagctagccgcgacatgtaagtgaatggcggttaacaacagtagtgcgtacgaacatccgtaaccaaagttcctatctccggtcttagccccacttattgactggtgtgaagtccgacacggcgatgaacacagcaacaacacagacaagccaagaagacacctgcggtcgtggtgttggacaaagcggtgcgatgtacaccgagaatttagcacgtttttattttttggaatggttcggataagcgcagttccggttgcggatcaagggatcgcggtggtcacctacgccaatttcggcatcgatgaggcagccgcgagaaaccctgcaccctttgggtttcatgtggtcgccgtggcgcgtcatggggaccggaacaccgcgctactcgacgggatcggcagaacggtgatcgtgatgaaaatcacaaattatggcgcggtcgaggcgttgctgcgcagttcgaaccgggttgatgtgctggtcaacaaccccagtggcgcgtggggcttgaaattcgtcgccaacgacgatttattgaagcattgacgctggatgtgggctaccaacatggtggatacgctccagctcagctgggcactgctgcccaagctgatcgactccggcgacgtcctgatcatcatgatcacctcgattgcgacgatggggattttactgacggcgacgctgactaaacggcggtcagcaagcccagagcacctggcgctgcacgctacgcagcgtagaataactagggaaagcccggtacgactcaccgagatcgcgccaggcgtggtcaaaacagagttctcgatgtccgcttcgctggtggccagcagcgcgcggacaccgcctacgccggaatgacactgctggcgtacactgacgtcgcctaagtgatcagattcgtgatgttacaaccttcccatgatcaacgtggaccagaccatcttccgatcacatgatcaagcgtcaaccacccaccgcgctaaccaccgggtctagccgtccctgaaccgctcgtcggagtgcccgacaagataggagcacccggcggggtgaccggcgcggtgacaggaatctgagtggccggctgatgcaccgtcggaaaac

SEQ ID NO: 129 - DNA (genomic), 42931 bp, MYCOBACTERIUM LEPRAE; double-stranded, circular
  hypothetical: NO
  anti-sense: NO
ggcacgggctggatagccagggccacagtccgcgccgattccagacgtgctggcgccatcgcattagcggtggtggtgccctcgcggtgttgatcactgtgttcacctcgatgctggaccggcttgcatcggtgatgtcagcgaagctccccggtagaaaaggttgtgtcggtaacccctagagcgttcacacgtacgggtgccggacagccagctggtcctgatcggccggtggtggttcagcgtggttggtctggtgcatacctctgggctagtcatgctggtgcctgacgtgtggatcgtcgatgcggggcagagtctgtgggcggtgcggacaccatcgggttgcacatggctcgttcgctgggcgacggagggcagatcgttgttgggttggtctctcttcgggcagccgagagtgctaagcagcttgatgatctcgggctcagccacgccactggaatcagggctgtcatcgggatcggtcatgtagaaggcgaatgagatgcttgaccacaataccgcgaccgtgcagcagctggacgctcggttcggggtaggactggtctccgtcgtagtgattgtggcctggcggcagccaacggcaagttcatttgcgtttgtttaccagctcgtcggtgttgatggcgtcggttcggcgcggctagaggagggcctatgtgctctggtccgtgtttgacgcctgtgtgccacctcggccccgtggaatccgcggtggctccggttgatgtgctcctggttccgacagctttcaccaggtgggtcgtgactgctgttggtatgctatggctgatctactaaacttaaccgcgtggcttcggctaatcagcaccggcctggtggcgatcggtatggttggtgtggagtgtgggctaacgaccgcattgcgtgcaaacacggtgagtcagcacccgattatcgcagttttcggaacacgcttcggtgatggtcatccccaaggaaagtgcggtgtcggtgggcccaggtggtcagcaccggctcatgtttcgcgcgaccctataggcttcgcgccgaagagatgtcgggccaggtaagtggctttcgcgccggacatcggactttcggctcgcaaaccgccctcgaaaccaacacagtgatggttggccagccggtgtggttcgctgcgagtagcacccgcctggccagctatgatctgatctgacggtggcggtccttaacgctacaggcattacgcacttgacggcggtatccggggacaacgtgacggtcgtgtgcgcggcggtgctgttctcggtccggctgattggcccgcgcgtggccgtggtgttcgtggcagtggcactgttggcctttgtgatcatcgaacagcccacagccagcgtgctgcgtgcggcgccatcgtgttgtcacggcatactgtcttcgctttggcgataaacgattcccacgctgttcgccactgcgttggtcttgttagccgttgttccttcacctggccgttgacgtgaacttcgggctgtccgtgctggccaaggccctactggtagtcatcgcgcaagtctggttacggcacttggtcgcgcggaggtgccccgagtcgctaaccgatgccctggccgtcgtgtgggccacgtacgtggttaccgctccactggtgctggcgtcttggcccggttcagccttgttaccgctgccgccaatctcgcggtggtggctgtgataatagcaccgattaccgtggtggctgtgttatgcggcctgtgtgcctgcggcaatcgttcccggtccggctagtgccctcggcgtgctgctgctggtgttggtcctgtggcggtgctttcgggtggcgatgatttcagcactgatggtcgccgttgcgtgcttgcctgattggttgtcagggttcctgaccggcgggcttatcgcgggctcgtcggctcgtcgtgccaccatctacggagtgagtaataagttttcgtcgctgcacttggtcctaggaaatgaggaactgctggttgagcgggccgtgggggaggtgttgcggtcggcgcggcagcgggcaggcacccaggacgtccccgttagccgaatgcgagccggtgacgtcggcacctatgagctcaccgaactgctgagcccgtcattgttcgccgacgagcggattgtcgtgctagaggccgccgctgaagcgggtaaggaggccgctgcgctgatcgtgtcggctgccgctgacataccgcaaggcacggtgctggtggtggtgcattcaggtggtggtcgagccaaagcgctggctaacgagctgcagtcgttgggtgctacggtgcatccctgcgcgcggatcactaagcttagcgagcgtactgattttgttcgaaaagaattgcgttcgttgcgggtcaaggtcgacgagggggcagtgaccgccctgctgaacgctgttggttctgacgtgcgcgaactcgcttcggcctgttcgcaattggtagccgacaccgccggtgatgtcgacgccgacgcggttcagcgttatcacagcggcaaagcggaagtgaagggctttgacattgccgacaaggcggtcggtggcgatgtctcaggagcagtggaggcgttgcggtgggcgatgatgcgcggcgagccactggtggtgttggctgatgcgctggccgaagcagtgcacacgatcggccgggttgggccgctgtccggtgattcctaccgcctggcgtcgcggttgggaatgccgccctggcgggtgcagaaggcacaacaacaggctcggcgttggtcgcgtgacacagtggcagccgcgatgagagtggtggctgcgctcaacgccgacgtgaaaggggccgccgcggacgcctactacgctctggaatccgcggtcaggaaagttgctgagctggccgccgatgggagccgatgagttgcagataatcgtcagctgcggccttagcttggctcagagtttgttgagagtacgagccagtgccgacttcttgttagccgcctggttcttgtggatcacacctttgctggccgccttgtccaatttgcggctggtcgacaccagcagcttcgctgccttctccttctcgccggcatggaccgcctcgcggaacgcgcggacagcggtacgaagcgaagacttcaccgacttgttgcgcaatctggcgcgctcgttggtgcggttgcgcttctgctgcgacttgatgttggtcacgcgttaaattcctttgtcgatttaggcgcgagtgctcttctactctacggcgacaaacttttagagtaccagtcggctacgctttctcacaaaagcacaactttgtgctgctggaacggacaatttgaggcagcatgtctcaggtgagtcttcccagccagctcaaggagactggaccacggttgcagtctcgttgccggtcctccgcccggtctgagcgcattttcggtgggtacaacacctcggacatctattcaatggcctttgacgaaatgttcgatgttcaaggcaatgttcgtggtccgtacaagggcatctacgctgagctggcgccgtcggatgcgtccgagctgaaagctcgcgccgaagcgttggctcgcgcattcatagatcagggtatcacgttttcgctgtcgggtcaggagcggccctttccgctggacttggtgccgcgtgtgatctcggcatccgagtggagccgattggagcggggtatcacccagcgcgtcaaggctcttgagatgtacctagacgacatctatggcgatcaggaaatcctgcgcgacggcgtcatcccgcgccgcttgattacctcgtgtgagcactttcaccgccaggcggttggtattatcccacccaacggcgtgcgcatccacgtcgcgggcatcgacttgattcgcgatgacagcggcaatttccgggtgctcgaggacaatcttcgctcgccgtccggggtgtcgtatgtgatggagaaccggcgcaccatagcgcgggttttcccgaatctttttgccacccatcgggtgcgagcggtcgacgactacgcctcgcatttgctgagggcgctgcgtaactcggcagccaccaatgaggcagacccgacggtggtggtgttgactccgggggtggccaacgcggcttacttcgagcactcgttactagcccgccagatgggtgtcgagttggtcgaaggacgtgatctgttctgtcgcgacaaccaagtatacatgtgtaccaccgagggggagcgccaggtcgatgtcatttatcggcgtatcgatgacgcttttctagacccgttgcaattccgtgctgattctgtactgggggtggccggattggtgaacgctgcgcgcgcgggcaacgtcgtcatctcgagtgcgataggaaacggtgttggcgacgacaaactcgtgtacacctacgtgcctaccatgatggagtactacttacgggaaaagccgttgctggcgaatgtcgatactttgcgctgctggctggatgacgaacgccaagaagtgcttgaccggatccacgacctagttctcaagccggttgaaggttccggcggttacggaatcgtttttggtcccgatgcctccgagaaagagctcgctgctgccagtaaaaagattcgcgacgatccccgaagttggatcgcgcaaccagtgatggaactctcgactgtgccgacccaggttggtagtacgctggcgccgcgttatgtcgacctgcggccgttcgcagtcaacgacggcaacgacgtgtgggtgctgccgggtggacttactcgtgttgcgctggtcgaaggttcgcgggtggtcaactccagtcagggcggtggctccaaggacacctgggtgctggcgccgcatgcgtcgtatggcgcacgtgagctgggcgccgctgaaatcgtgtgttcattgccgcagtcgtcgcccgacccagtgcccgacggatcgccgcgaccaaaacaacagccgcagcaagcgcaagccgagcaagcgcagcaaccgcaacagcagataatgttgccctgatgcttgcccgtaacgccgaggcgctctattggatcggtcgctacgtcgaacgtgccgacgacaccgcgcgcattctcgacgtcgttgtgcaccaattgttggaagattccagcgttgatcccgaccacgcctcgaggacgttgctgcgggtgctcggcatcgagctcccggaccacgagttggacgtctggtcgctgaccgatctggtggcgttcagtaccaatgctcagggcggctcttcgatcgtcgatgcgatctcggcggcgcgggaaaacgcaaaatcggcacgggaagtgacatccagtgaaacctgggaatgtctcaacaccacataccatgctctcgccgaacgcgaacgcgccgctaaacgccttggtccacacgaatttttgtctttcatcgagggtcgggcggcgatgttcgccggcctggctgactcgacgctttcgcgtgacgacggataccgcttcatgctgctgggccgcgctatagagcgggtcgacatgacggtgcgactgttgttgtcccgggtgggagatagcgcgtcgtcaccggcatgggtgacgctgctacgctcggctggtgggcatgacacctatctgcgcacctaccgcggtgtgttggatgcagcccgggtggtcgaattcatgctgctcgaccggctgtttccacgttcgattttttactcgctgaagttggccgaacacaaccttgacgagttgttgcgcaatccgcagagccgagttggtgccacaacggaagcgcagcggttactcgggcaggcccgcagcgaactggaattcgtgcaacccggtgtgctgctgaagacactggacagccgcttggctagcctgcagaccacttgcagggatgttggagacgcattggtgttgcagtattttcacgtcgcgccgtgggtagcgtggtcggatgccggccaccggggacgaatggttggcaagcggggagaagcctgatgtggcggatgcgggtggtgcacagcaccggatacgtgtacgaatcgccggcgaccgcctccttcaacgaagcccggctgacgccgcgatctaatacacggcaaaccgtcatcctcaatcgtgtcgaaaccattccggccactcggtcctatcgctacatcgattattggggtaccgtggtgacagcgtttgacttgcgcgcgccgcacaccgagctgacagtgacgtcttcgtcggttgtcgagactgaaagccttgaaccatcggtgagccggatcacctggactgaactgcagtcgatggccgtaatagaccgatttgacgaagttttgcagcccaccgcatacaccccggtaaacactcgtgtagcggccgtcggcaagcggatcgccaagaatcacgaacctcggaaagccgtcgtcgccgcagcccggtgggcgcgaagtaagctggactacattccaggcactaccggtgtgcattcgtccggtttggacgcactgcaccagtgtaggggagtctgtcaggacttcgcgcatctgacgttgattgtgttgcgcagcatgggaattcccggtcgctatgtgtcagggtatctgcaccccaaacgcgacgcggtcgtcggaaagacggttgaaggacgcagtcacgcctggattcaggcctggacgggtgggtggtggaattacgatcccaccaatgacgttgaaatcaccgaacaatacatcagcgtaggtgtggggcgcgattacacagacgtggccccgttgaagggaatctactctggtcggggggcaaccgaccttgacgtggttgtggagatcactcggttggcttagtcgcatgaatgattggtcggcgcaaagaatcaacagtgctggtataaccaaggcgctgcggagtcgacttatgcccggtcggggactggcctgcatggggtggctgttcggtggacttgctctcggcgtcgcgctgggctgcgtgatcccattgtcctacgggtcgatagctggggttgcggtcatacgcttttgccgaacccaatcgtggtgcaagctatagccactagtacgtttgcgtcctcggcgccgctggcgctttacgcggctatggtcagtatccggttgtgtcagttgggtagcgaccgcgtctgccgccgtgatagcgttaactggcggtgtcttgactgccggcgcattggtgctgaccggattgttggtctacccgctgtcgcaactggaggtcaacgcggacattgcgctggttcgggcgagttcgttgctgatatctctttctggttggcagcccagggcacctggtggtgttgggtttgctggtcgccagtatggcgtacccagcctaatgcggggtctcatgcccagatcatttggtatgtacaggcttggcgctcgccgcagaaacaacactggtgttgatctggccgactgccgggtgcggatttactgtcggtcgtacgcgtcgctgcgttgttccggctgatagaggtcggcacgctatggatgcttgccaaccccgattcggtgtaggtcgttgtcaaacttgatttgccagttgaacctggacacggtcagctctcgtcaccgtttctctttccctagggacatagtacgttatgaccaggatgcctatgcccgcgtgcgccgcggttgctgtcgcttgctcgattgacgagtgggggttgcagatgtccttgatctgcttgttggtgaacgcggatgacgatgttcttgcggattatggtgtgcaccaatgcgtcggcctcggcggcaagctcgtccaggctggcgcagggaaccgtgcctccggtcagcaccaccgaggtcggtccggattcgatccggaatccgatcgtcggcgtcacaggcccgtgattcgtggaaccccggatcgacacgccatcggggggggctccaacaaaacctttggtgtattcgtatacttcgatcagtgggggcgtattcaggtaagtgtgatgggtgatctgatattcgatgtcgtgaccggacgccttcagctttgcctctaccgtttcagcggtgtccggagatccgatgatcggcagcggtgggggatccagcgcgaaggtggttacccaatgcgtgatgagcagatcgccaaggtcgctgatgcggtcgccgtgcagatgagttgagcagcagcgctgacaaacagctggcgtgtgcgtcggaccagccgacgcacgttgcaacactccaagccagcagtccactaggaacagctgtctgccagcttgcaccgcgtcgagaaggccggcgcgggtcgggtcgggaataggggacttccggtgctgagcagtgtggtctcgatcatggtcccatccttgtaactagacgggtgcgcagtggcgcaatttattcattcggttggtgagcaagggtttcggcttctcgacgtgggcgagatgctggttgtcgacctgaacgttcgagcgttattggtggtgtgttttttgtcgactttcccatcagccgagttagccgtagcctggtgtcaaggagatcataactttcggctggaggcctagatgcagatcgcgggcgtcttacggagcaagggtgcgacggtggtgacgatcaatcgtgacgcgaatgttcgggaacggatcggccggtcttgtcgagcagaacatcggtgccatggtggggtcggcatcggtgtcggagcgtaacatcgtacgtcagcttcatgcgtatggcgtcagcgtgctgtcttgcccgatctccaagattatgactagcgttggttgccagctgccgctggtcctgtcctatatcactcaaggttaactgcgcggctcagcgccaggattagtcggcacgcagcgggctggctatggcatcgaagatttcacgtttcaagatcgtgtcctcgtggcgaatactctcctccggcacgtcgaacacccggtctagccggatccagctttctcggttttcgtaatcccaactgctagaggccgatgccaacccaatcttggtaggctgcgtggcgttcttggctggacaccatcagtcccaatacaatattgttgttgcggctcacgacgaggaccggtcagtcttggctccgggtcgggtcgtcctcatatggaggacccacttccacgcgattttgcaggattagctcggccatccaggtcaggggggcgtagagtagctcacgggttcgctgcgcggtgggggaggggaactaagcgcttgccactggccggcccgcggtaatcgcgacaggtggttttggcgcagctgcggctatacacattcacggtgactttgatttcatgctggagttcccgcagcacggcttgcgaattctgcacgtgacgggagaggtgtggagtccggcttaataccatgttcttggttcttggcaagccgttgtaatgttttccactatgactgccaggctgacgccatattcgcagtataggaccgaaaggcccggcgagattgctgtgccagtgtgtcttggtcacttcgcgtggataagccggacaccggcgaatcgccgttcaaacattctctagtaactggagcccaggagattcccatcagcagtttcgctgacaagacctttaccgcgccggcgcagattaggaacttctgcataatcgctcatattgatcacggcaaatccacgctggcggaccggatgcttcagctgactggtgtcgtcgatgagcggtcgatgcgtgcccagtacctggaccggatggacatcgaacgtgagcgcggaatcacgattaaagcgcagaacgtgcggctgtcttggagtgtcacagctggtgggacgactgagaattatgtgttgcacttgatcgacacccccggccatgtggacttcacctacgaggtatcgcgagcattggaagcctgtgagggtgcggtgctgctggtagacgccgtccagggcatcgaagctcagaccttggccaatctctatctcgctctggagcgtgacttgacgattattccggtgctaaacaaaatcgacctgccggctgccgatccggaccgttacgccgctgagatcgcccacatcattggttatgagtcaggcgatgtgcttcgggtgtccggcaaaaccggcgagggggtttctgaccttcttgacgaggtggtccgtcgggtgccgcatccgcaaggtgaccctgatgcgcctacccgcgcgatgatcttcgactccgtctacgacatctaccgaggcgtggtcacctacgtccgtgtggtcgacggcaagatcagcccgcgtgagcgcatcgcgatgatgtccaccggtgcgacgtacgaactgctcgaggtcggcatcgtgtcgcctgaaccgaaggccagcgcgggcctgggcgtgggggaggtgggctacctgattactggggttaaagacgtccgccaatccaaagtcggcgacactgtaacgacggttcgttatggtgccactgaaccgttaactggctaccgagaacccaagcccatggtgtactccgggctgtatcccgtcgacagttcggactacccgagtttgcgtgacgctctaggtaagttacagctcaacgacgcggcgctgacctacgagccggaaacatcggtggcgctgggcgttgggtaccggtgcggcttcctcggtttgctgcacatagatataacccgcgaacgcttagagcgcgagttcgacctggacctgatctccacgtcgcccaacgtcgtataccgtgtggtgacagaagataacaccgagattgtggtgaccaacccgtcagactggccggagggcaagatccgaacggtgtacgagccagtggtgaagatcaccatcattgcgcccagcgagttcatcggaacgatcatggagctgtgccagtcgcgccgtggcgaattaggtggcatggactatctttcacctgagcgagtcgagttacgctacattatgccgctcggggaaatcatcttcgatttcttcgattcgctgaagtcacgcacccggggctacgctagcctcgactatgaggaggctggcgagcaggaggcccaactggtcaaggttgacatcctgctgcaaggcgaggccgtcgacgcattcagcgcgattgtgcacaaggattcagcctctgcctatggcaacaagatgaccaacaagctcaaagaactgatcccacgtcagcagtttgaggtgccagtacaggcggctattggatcgaaagtcattgcgcgcgaaaatattagggcgatacgcaaggatgtgctgtcgaaatgttatggcggcgatatcacccgcaaacgtaagcttctggaaaagcagaaggaaggcaagaaacggatgaagaccattgggcgggtcgaggtgccgcaggaagcgtttgtcgccgcgttgtccgccgatgccgcaggagacaaggacaagaaataacctgttcgactttatgttgacgaactgaagcatcaaaagattgttctgcaagcacattcaatatttaagcgtgcatactcttggcgcattcgggtgctgtaacatccccgcgttgtcggcttccttgtcggcgcggatcacatggaccacttcgtttatcaacgccagacgggtgaacgcctccggggagttgtccaggtgccgcccggtgcgtggctcgatttcttcagcgtagaggtgcagtgggctcgtgtaggaaaacagtcgcttagcgcaggttacctcaccgatttccaccagcgcggacaccagccagaatgattaaatggtgagcatgttttcttcgccggataacccttaattggtttcttttatccggtatcgcagcactagactctcttcggtgagttaattggcgacagccagcccagtgttaagcacgcgcgggtcgtcaggtgccaggaatctggtcagtagcactagcaacagtgaggaatccaacgcgtcgttgccataccgctgggtgaatacgtcgcggtagtccatcccatgctcgagaatctcggtcttgatctcttcagcgatggccagtcactgttgggtgcgtttttcttaccctaccgttcggttagcttggcctcgcggtccagagccatccaacacatcgtcccaacacatcgtgaagtgttgcggctcgccgcgaatctcccagattccgcggtcgggctcacaccagtgcgcgatcacctctttcacctgctttttcaatactggctacaatatttctgagattttctcgagcgacttggtgtgcagaagaacgagtccagaatccagccctagatatcgtgctgaacttggtcgtaggagtcgtttgccgattcgcaccggccgcgcgtggtcgtagccgaacagatgatataatccgtcttcaaccaggcggcgttcgtcgcctaccatcacctgcagcagatggcgctggtcgttattggcgccggatacattgacgatgtatgcggagaagtcgtcggtttcgtggtcgagtcccagggtgtaaagccccccacaacgcgaacgttgaatcgctcacccaggtatcgtggtactcccagttgcgttcgctttgtgacgtttccggaagtgacttagtgctgccgggccgttagccagcgcgccggtgggaggatacgggaacctgttgagtgttagcgtgctgtattacaggtatgcccgcgacgggtggtcggggaagtggccgatgttgatccactgccgccagcattgggtgacctgtcacatcttgtctgctgcttctacataggtctgtgggaccgggtgtttggtccagcttagcgtgacgaacacgtcgtcgccctatttcatccggatgcgtgcccgtgttttacggatctccaacctgatctgcatattcatattggtggttaaccatggcgccgggtggatgtcaggttgtttgctggcatgtgtgatggcttcgcgtaggcatgggtcaagtattctcacacggcgccgatgcgatggtagtcaaacgccggctcgcagctcatcatcagctcaacggtgccgcttatgcagagcaccgtgcacagcaggatgtgcttggcgtcctaatccatcgtgatgcgttagtgatcggcgctcgatgtcatggccatgtcccccataaccggcacgttccgcacgattaaccatccggtgtgtggtctgccatgtggtttccatgatcaagctgctgggaaatagcggcgggtcgacggtaccgaggccgccgtaggggcccaatcggaaatggccggcgcttgttagtccaggatcgcttcgaacacactcggagagtcaggctggggcagcctatactccatagacattccaccgaaacggccgacgagatcaggcacgtcgtttcctagtcggacaagaaatgcgtagtcagcgatcgacggaaacgggttgcgtagcacgccgctggaggcaactagcgcctgcgagttgaaatcgaaaggcgcgggtttggcggcttgggctgcggtaaacactgctagccgcagcagccttgtcgtcggctttggcgggttgataggaggggggcggcgtgcaggaccattccgccataatctgtcgattcttcctggtgtccatcgtttgcttctttgcccgaggggttgtggtctctacccggcgtgcctggcgtacttaggcatgttgttcggataacaggccaatcgcgaccaggtaaccgacgaaccgtcgcaatgccagtgttcggctcaccatccgagccttttgcggtggtgtttggtcactgctgtccaccgcgacagcgatgatgttgtcatggataacccggtgtgccgcctacaggatagtcgtcggaatccagtggcgtagctgtactcgaactagctgccaggttgacacgcgttccgtacacagaggacaggtcagccggggagcggccgctaccactaggtttatgcctacgctggccaccgcggcatcacgtgcgcagcgtcgtttatgtaaatgatggcggtgatttatgtatgtattattatgtagtcgccgctgtcgatcgtgatcgtagtgtgccccgcgtgagtatatcggccaggccgaacgggtcgttgggccggcgaggcaatcggaaccaccacacgttcatcggagcgccgaagctacgcggtgtcagtgctattgctgagcgcatggtcgacggggcggccatcgcaggccaccgctaagtcggtgcgtatgatcacttaggtcaccgcggtgctgcacataagtcggaacgtgggctccatctcggcaccggcagccattatctccagaaagttccactgcggctaccaggatgatgcgttgatgtgtgccgagcaggcggctcaggtccagattgactcacttgccctgtatctccatctggatggtgtcgattttgcgatgcagaatttgtgcgaataggtgggtcacagatcgagttcgtcaagtagccacaaggtgcttgcgggccatggcaatcggatcgctggccaaaagcaggccaagcatcatgctcgccggtccgcctccagcaatgaggcatgtagttttgtcggatgtggaaggcacggacagcattgggcgatcttgacacagtgttttacgatgcggggacggcgaatgggacgaatgggattagtgtgagcccggtgaacgggttcctgaattggtgggacagcatcgagctttggctgtcagggctcgccttcgtgttacaggcggctttggttatgccggttgtccttgcgtttgcctacggcaccgcattagtgttagatttcgcgctcggtaagggcatccagttgatgcgtcgagcctatcaccctgattcggcgcgcgggtaacctgaatgcctcggtcacatgttacgttggtgctgttcgttctagtggcgctggtgatagtggcgtggctgctgacgcgctgagtagcattgggttgctaaccagcttagctgtgatggggcagccgattctgttaagttttgcgccatgcacgtagcacccggtgtttgggagtgctgtgtcctcgtggattattgttgctgactccaaaacccgtgcgcggtctggtacggagttcgtgaattttccctagttctaggtggcccttgcgtaccaacgggattgagatgcctacgttcctcactggaaggcggctaatgtttaaagacattgggcgattcatgcgctggcggcactcgatggtcgtcggggtcacgcttgcctcgaccaccgatgtggttgctgcgtgtcatggtggtgccagtgacgtcgttggcggcgggacggcccatgcgcatacgagtatcgccctggtcgcttactcggcgccgggacctggttggggcaaagtgattccggcgtttaatgacgctcggtcgggcgatggtgtgcaagtggtaacgtcgtatggagcctctggcgaccagtcccgcggtgttgtcgatggcaagccagctgacatcgtgaatttctcggttgaaacggacatcaccagattggtcaaggtaggcaaggtgtccaaggactgggataccgacgccacgaagggcatcccgttcggatcagtggtgacattggttgtgcgcaccggtaatcccaagaacatcaaagattgggatgatctggtgcgccccggtgtggaggtgatcatgcccaatccgcttagctcgggctcggccaagtggaatctgcttgctccgtacgccgccaaaagcgaaggttgccgcaatagccaggcggggattgattttgtgaaccggttggtggccgaacacgtcaaattgcggctaggatctgcgcgcgaagctaccgatgcctttgtccagggcagcggcgatgtgctgatcagctatgagaacgaggctatcgccgccgagcggcagggcaagccggtcgaacacatcaacccgccggttaccttcaagatcgaaaatccgttggcggtggtgagcaccagcgcgcacctcgaggtcgcgaccgcgttcaagaacttccaatacaccactgccgcgcaggggttgtgggcgcaggcaggttttcggccggtggatccggcggtcagtgccgatttcagcgaccaattcccggcaccggtgaaactgtggacgatcgccgacttgggtggctggagcacggtggatccgcagctattcgacaagaacaccggtagcatcaccaaggtctatatgcaggccaccggatgacggctcgttaatcgatactcgttcgttgtgtcggctcggtactaccacgtagcttggggttggtgcggcgatagtgtgggctttcggtgatcgtgctgctgcccttggctgccattgtgtggcagaacgccggctgctggcgccctttcctgtctggtggtcacatagcacgccgtgatggactcgctgcgggtagatgctgaccatctccgctggggtttgcggtaatcaacattgtattcgctctgctgattctttgggtgttggtgcgtgatgacttcgtcggcaagcggtcggtcgatggcggtatcgatgtgtagtttgcgttgcctacgattgtcgccagcctggcgatgctggctctgtatgggaacaacagcctggttggtcttcatctgcagcacaccggatggggcgtgtgggcggcgctggcgttcatcacgttgccgttcgtagtgcttactgcctaatcggtgctgttggagatcagtccgggcggccaaagagtcggtggcgtcgttgggtgccagcagtccgaaaaatcgttatctcggcggttgttttgccgtcggtgactccggtgttgttatcagttgcgggcctggagttttcgcggatgcttggcgatttcggtttgatggtgctgattgatggtccggtgacgaggaagatatcagtgtcatcgtagtggattcctgaccttgatcgagaatcacgaccgcactggtgctaccgcaatatagattgcactgctgtcgatctcgtgtgtcgtgctctttttactgcaggtcgtaggcgcgcatgaggactgatgcgaggagatagccacatggcgacattgccgcaagttagctatctgatcctgtatgtcgcctttgcctacattgttgtgctactggttatgacgtttgcgctgatcttatggcggacctttgcaccgggcttcggtcaattctacgcctgagtcagcacgtcagaggagggattggcgctgaacttgtcgcttctggtagtggacatcccggttccgctgaacgtggttttcggaattccgacgacattggtttttttatcaacatatttcgacgaaaaggtgcactgcagacgatcatcgatctattgttagcggtctcatccgtcatagtaggtgttgcactggtcgtgctgtggggatcgtgcggtgcgctgggcttcgtggagaaaggcttggagttaacgatcatctttggcctgtccggcatcgtgcttgctagcgtcttcgtcaccctgccgtttgtggtacgcgaggttgaaccgatgctgcactaactggggtccgaccaaaaccaggttgcggcaatacgaggatctagctggtggcagaaattctagcggattatgctactcttcaaccggcggcacgtagcctacgccattgtgttaaccgttgcctgtacgttgggtgaatatggtgcttatgagttgttaactttgttgattacggtatccgcggtggtcttttgagtatccaggtgggttttgattcctgccgggtacgagcaggcagaaacgtctgactaagggacgtggagatggccgatgaagggactggccaggacacgcacaacgatcatcgtgcgcgaacgtctacaaactctatggccacttcgtggccttgggccacgtggcgtcatcgtgcccgccagtttgctgatggcgttgttggggcctagcggttcgggtaagttgacgctgctgcgcatcatcgccggccttgaccacccggacaccgaaaccatcacaatcacggtcgcgacgttacccaggtgctgccgcaacgccgcggcatcgtttgacattatgttgtctttgagcacatgactgtgcgcgacaatgtggcctaagggcttgagattcgtaggcgccttaaggtcgatctggtgctggctcgagccctggcggtagatttgcaggtgctgctgttcgatgagttcttgggcgcattggacgctgaggttcgctaggatctgcgggtttggatccagtgcctgcatgacgatgtgcacgtcaccacagtgcttggttcccaaggatcaggcctaggatcttgacaatgtcaagcccagttatgtggctaacggcagggctgggctggcctcggggatcgttatggatcgctaggacgaagaatttgtcgtcgccttgaacgactttaatgtctatgcagcccgctgatgaggatgctaccgatgagaaggacgggtccagggttgaggaaaatttcctgcgacaacttaagggagaacactggcattatctggggtttctccatcggtgcgcgctggttgggctcccagtttggatgcgctagctttttcatcgacagctacagcttttgctcgatgccccgttcgctctgggcctccagagttttggccatatactggccgcagcatggtccgacccctgccgtgactggcttggtgtagcctggcttaccgggcagtacccggcttggtttacacccttttgccggagtagcccgacaaaatgtactgtcatcaggtggcttggtctgtacattactgcaagcatggcaggcctgtaggtggtgaatgtcatgctgatggtggtcagtgtggccaggcaagttgtatactgtttctgccgagtacggcgcgtaataaccagcgacagtcgctacgtccactctccgcgtccaactcaagcggctcaacaaacaagtaggccagtcttctgatgaggaagttcaacacgaagccgagcaccaaaaagccagcgatgttgttgatttcgctaggcttgtctttggctagttcttcgcatccgtgccggccgatggccagcaaaagatacatggtgaagctctggtagatcacatatggaaattcgaagcttatccttctggatggggatcaaaaacccgcattacattagaagaacagcatggagtggcttgaacaggttgtgggtgaagttatcccaaaattcttgaaacatttgagcggccctcttgtgtgtgcttgctacggtgctcacggaagcatcgaatgttagccggagctgacctagaacatctaagcaaatgtcgacacttagacttgctcaggctaatccgcagctcggtacacgcgcgggcttgtgaactggattatggatgtgccctgtaagccctgatgcaaggcggccgagacagtcaataagcatcgacgagacagtctattaggtatcgacaggaccactattgggcgttcgaaaccaacgagggtgcacttcgacgcagcgtttacaacgtatcacggcttgccaccccgatggcaacacggttcgcgcctaaacacggtttagatcggggcggtgttcacggtctttttcgtcgccgtcgtcccacctgcggctggagcgttgaatcaactgtctaggtcggctgcgcacctactgtctggccagcgcggtatcgttggttggcctaggcctcacgttcatcccgacgacaccgactgtgatcgttgacctcgctgtgtcttgcactggcgtgttctgttgagcaatcctgcgcgaccggatatccggctgaggccggtggtgcggagcgatccagtcgggttgggttgtatctgacgttctactacttgtctattacctgggtgggagcgttggaaccatggcgcttgcgtcgctctaccggtatgtagtggtggtcagcctgcgtcggtttactcgccgtcgtggtgcatcatcagcatggtcgtcgcgtgcgtcgcctggcgactggagctgatacaccgagtgattgacctggacgccgctggcggtggcgcaggttgtctatgcggcagtattcagtgccgacatcgcttgcccaacgtaggttaaccaggcctgctagcagaagatagaagatcctgagttgctgcatagcttcgacacaggttgcccggcgaagccgaacctagctcggaggtagcatggtcgctcgagatacgaaagaccaggaacaaggtgtgcaccggatgcatcatgtgcatcgtccatggaacacgtgaacggcttcatcagtctgtgaccgtccgccacaatgcatcctaatcgaagagaaagagatgaccatgaaatccatcgccacctatgcagcgctggccataatcggagccgccgtcgacggcctgacatcgatggctatcccgacgggcccggccgcgtcccacatacaacccgttgccttcggtgtgccgctgccgcaagatccggcaccggctgcggatgtgccgaccgcagccgaattgaccagtttgctcaataaaattgtcgatcctgatgtttcgttcatgcacaagagccagttggtcgagggcggaatcggttctgcggaggctcatattggcgatcgcgagttgaaaaatgcggctcagaagggtgaactgccgttgttgttcagtgtgacgaatattcgaccgggtaccagtggttcagccacggctgacgtttccgtgtcgggtccgaaactcaacccgccggtcacgcagaacatcaccttcatcaataagggcagctgggtgctgtcgcgccactccgcgatggagctgttgcaggccgcggggcgttgagcaccgcggatcccgtcactgtctgcgctttaccgattcaaggctctacaggttgagtttgttgatctgatgcggatcggccagtacttcgatcgcggtgatccgtccgtcgcgtgtaatgaaccccatgatcgttgttgcttgaccggctacgtaaatgaccgtgcttacggtgcctttgacggttgcagtgcgcacttcgcgttccggcagcgtgtagctgcgggccagtttggcgactgaggacacaccctggacagcacgggtctggcggcgccgggtacgacattaccgcgcagcactacgtcgggatgcagcaccgacaccaatcgggcgaagtcgccgctacgccaggctgcgcaggaacgcgtcgactgcttcgcattgcgcggctatggttttcgtcaggaaccggaatcggtgtgctagatgcgtcggtgcacaactgttcagcttgcaggttgtctccggggtccgatccccaatgggatctgttcgaactgtacggcgaagaatgtcgtgcaagacgaacgccaaccgctccgccggctgcaacgtatacagcaccaccaacagcgccagccccaccgcatttgatcagctatttgcccgatgttcggtgtcgaattcacccactggatccaccaccggatctgttatatgtgaggccagtcctggtgatcgcgaccgacagtcgcagcgatctaggcaaatgcgggccaccacggtggtcagccaagttcctagattgacgatggtcggcgcgtgggctcctcggtgctgctcagccgtagccacgcttccttcttcacggcgtcttgagcgtaaatcgagcccagcatgcggtattcgagggcgcccgactggcggttagggcttcgcgtcgaagcgcgccgtcaagggagtttcggacgcatccacaatacatgtgccgccggcatccggctgctggctggtgtaggggagcgcgcagactcggccggtggaaaagccgaatgacccgatgctgtgaagtgggcacgcaggttgcccagcgtgatgatgtgggtcagtatcaccagctgggcggttttgcagtgggggcgtagcttatctaaaaattcgtagctcactccgaccgggatgtagctaatcgcggtggtgtattccaagatcggtttgtcgacgtcggagaagcgggaggcgtgctggtaatcggccatcgccagcagttcttcgtcggtgatcctctattcgcggacgatctgcgaactcaagtcgatgcagaattcgcagtgaaccgttgtcgatgccttccggttaggccagtgtgcggtagcgcggatggagaacacccagtttcgattaggcctgcgttagcctgctttaggcattcaatagacttgatatatactgcgtataatctgcagcgattgtatcatgttggcagtttccagaccagccgtctgcggccagcttccgcttagtgaagaaaaaggcgattttggcgcttaggccggcgtcgtggtcggcgacttcgattggccgggacatggcgatcttcctgacatagggctaagactttgtcttcacttagtcgacacctggtggccgcgaaacgtgaccggtttacccatgcgctcgggccttaagtccgtcttcccatcggcacgttcatgtcaaagccccgcgcatgtagcaacgtgcgattgtgtagtgcggcgtgcactgcccaatgtaggccatcctcgcgataaatgcctcccctgccacctcaccgtatgcgggaaaggttgccatagaacgtggaatcttccgacagtaagaggtcgaacgcgaaaacggtcgtggtggtagccaaattcgtcgagcctaaaatctgctacaattggatttttgtccagttccggtagcatagcccatgctcggggggggtatggtttgccgtgtctggcgcctttgaagatcatccatgcaactttgttgacgcgtcgctcaagatcgactgggtcatgagcccaggttagccggaaaatcccgggcctaataggtcgcaccctggctgcacggagggctgccgacaattttgtctgttccaagacaaaacatcgatcatgaacttagcgttcaggttggtggggcaactggctcaggcgcatcgagttaggtcgatttaagataaccgccgttgcgggtcggtggtcatcgctgacgacagtttctttaatcggctgatcaagacgccgatctgtggtggtgttgcaaacatgggtccggtattctgtagcatcactgaattcttccagcgggttcgcaggtgttggtgaattcttcgtgtagtgacagcaggatgtccatctgggttgtgtgagtgtgcagcggtacggtgggtgatgtccagatatcctaacgctcactcggtggacttgttgttttgccaggtcatcaagacttggcttagcggatggtgggccggcgctggggtgggcgtgagccataccaacaacttttcggcgatccgagtcaacgaacaagttcagtctttgaccttcatgatcatctaggattgcccatccaatctccaaggcccaccatgctgggggcgtcgagctggcatttcgtttggtcctttcgatcgcaaggccagcctctaagcggcttgggtgggggtggtaccaccgcccgacggccgctcatggcggccagcgccattgtgagaacgtaaaatgaacgcgactaaggaggtggactggcggtggggaatgccgacgagcgtcgctttgaggtgctgcgcgccattgtagccgacttcgtcgccaccaaggaaccgatcggatcgagggctttggtggagcgtcacaacttaggcgtgtccagcgcaaccatccgcaacgacatggcggtgttagaggccgaggggtacatcactcagccgcataccagctccgggcgagtgcccacggagaagggctatcgcgagtttgttgatcgactcgaagacgttaagccgctatcagcggccgagcggcgggcgatccaaagctttctggagtccggtgtcgacctcgacgacgtgctacgccgcgctgtgcgactattggctcagctgacctgtcaggtggccgtggtgcagtaccccaccttgtcgacgtcgaccgttcgccatctggaagtaatcgcgctgagcccggccaggttgctgatggtggttatcaccgagtccggtcgggtggatcagcgcatcgccgaactcggcgatgttatcgacgattaccagctctcccagctgcgtgaaatgctcagccaggcaatgggaggcaagaaactgtcggcggcctcggcgcggtagccgacctcgtcggacggtttcggggtacgggcgggttggccaatgccgtcggccgctcggcgaacgtattgctggaatcgctagtcgaacacaccgaagaacgcttgttgctgggtggcactgccaacctgacccgcaactctgcggacttcggtggttcactgcgatccatcttggaagccctcgaagaacaggtggtggtgctgcgactgctggccgcccaacaggaggctggcaaggtgactgtgcgtattggtcacgaaacggcggctgagcaaataatgggtacctcgatggtgtccaccgcctacggtacctcgggtaccgtctacggcggcatgggtgtgttggggcctacccggatggattatccgggaactatcgccagtgtcgctgcggttgctttgtatatcggcgaagttttgggtgctcggtgaacacgcacccgctacggaatctgtggacagccgcttagaagcggcataagacgctgctaggagagttaggcgtggcacgcgattattacgggctgctcggcgtgagcaggaatgccagcgatgcggacatcaagcgtgcctatcgcaagctagcgcgcgaactgcatcccgacatcaatcccgatgaggccgcgcaggcgaaattcaaggaaatcagcatggcttacgaggtgctgagcgacccggagaagcgtcggatcgtcgatttgggcggggatccgatggaaaacgccgcagcatctccgtcagggttcggtggctttggtggcttaggtgatgtattcgaagccttctttggcgggagttcggcatcacgtggtcccatcggccgggtgcggccgggctcggactcgttgttgccgatgtggctcgaccttgaagagtgcgcaaccggtgtcaccaagcaggtcaccgttgacactgcagtgctatgtgaccgatgccagggcaagggcaccaacggtgattctgcgccgataccctgcgacacatgcgggggtcgcggggaggtgcagaccgtgcagcgttcactgctaggtcagatggtgaccgcgcggccatgtcccacctgccggggtgttggggtcgtaatccccgacccgtgctgccaatgcgttggcgacggtagggtgcgcgcccgtcgggagatcaccgtcaagatcccctccggtgttggcgacgggatgcgggtccgacttgccgcccagggtgaggttgggcccgggggagggccagcaggcgacttgtatgtcgaggtccacgagcaggcccacgacatctttgtgcgcgacggagacgatctgcactgcacagtttcggtgccgatggtcgatgcggctctaggcaccacgatcaccgtagatgccatcttggatggtatgagtgagatcgatatttcgccggggacccaaccgggttcggtcatcgaactgcgtggccaagggatgccgcacttgcgttccaacacgcggggcaatttgcatgttcacgtcgaggtgatggtccccactcggctggaccagcatgacaccgaactgctacgcgaactgaagcgccgtcgcagccgtgacgtggccgaggttcgttcgacgcatgcggccggcggcggactgttcagccggctgcgcgagacctttaccaatcgttagcacggttttaacggttttaggggctccacatgtggtgagcacattgttctacgtcgacgcattgcccgataccggtacggtagctgtggtgggtggcgacgaagggtttcacgcggtcacggtgcgtcggatccgtcccggcgaggagctggtgctcggtgacggtgtcggtggccttgctcactgcttggtcgaacgggccgggcgcgatgggctatatgcccgggtgctggggcactggaccgtagcgccggggctaccgccggcgactgtggtgcaggcgttgcccaaggctgaacgctcagagttggctatcgaaatggccaccgaggccggtgccgatgcgttcgtggcgtggcagtctgatcgttgcgtggccagctggtacggggtccgggtggacaagggtctgcgccggtggcggcggtagcccgcgcggcagctcggcagtctcgccgggcgcacataccttcggtcgatggggtgttgaccactgcggcgctgctacagcggatccgggatgaggtagccgccggtgccactgtgctggctttgcacgagtcggcgaccgatcggttgtccgatgtctttgcggatatctctgtggcgcaagcaaactcgctagtgttgttggtcggtcccgaaggaggtatcgcgccggacgagattgccgcattgactgaggcgggcgccgtcgcggtccggctcggtcccaccgtgctgcggtcatcgaccgcggctgcggtggcattgggcgcgttaggcgtgctcacttcccggtgggatgcttcatcgattctgtaatccaagtcacgtttctaccgcgtcgttacagtctcacgaagtacgaatagggggctcaagcgatgaccagcagctgcgatcaggggtgtttgctggtgcaggtcgggagctgcggtttacggcgacttactgccggtcgctagcaccgcccagactcactaggtgctggacaaggacctgccagcgaatacgctgatgaacagctgacgaactagggcccctagcgtaggctaaaatattggcacgacccgtgttgacacgctcttgtacaggccaagaaagcaggcatcggtaaccacgtgacgcaccacgagaccagcgctgttgacgcatcatcggcctctatgcacgttcgcagcaccatcgatgttccgcccgacctcgttgtgggcttgctgggttcagcagacgagaatttgcgcgccctcgaacgcatgttgagtgccgatctgcatgtgcgtggcaacaccgttgcgttttcgggcgagccagccgatgttgcacttgccgagcgggcgatctctgagttagtcgccatcgtggccagcggtcatccgttgacgccggaagtggtgcgtcacggtgtagccatgctggtcggcaccggtaacgaatcaccggctgaagtcctcaccttggacattttgttgcgccgcggtaaaacggtccggcctaaaacgctaaatcagaagcgctacgtcgacgcgatcgatgcgaacactatcgtcttcggaatcggtccggccggcaccgggaagacgtatctggccatggccaaggcggtcaacgcgttgcagactaagcaggtaactcggatcattttgactcgtccagcagtggaagctggtgaacgccttggctttttgccgggtactctgagcgagaagatagatccttacctgcggccgctgtacgacgcgctgtacgacatgatggaccccgagctgatcccgaagctgatgtcttccggtgttatcgaggtggcgtcgttggcgtacatgcgaggtcgcacacttaacgatgcgttcatcgtcctcgacgaggcgcagaacaccaccgctgagcagatgaagatgtttcttacccgactgggtttcggttcgaaagttgttgtcaccggggacgtcacgcagattgacctgccgggaggtgccaggtcgggtctgcgcgcggcggtcgatatcctggagcacatcgacgacatatacgttgcggagctggccagtgtggatgtggtgcgccaccggctggtgtcggagattgttgacgcctatgccgaatatgaggagcacgacttggggatgaatcgggcggctcggcgagcgtccggcgctcgcaatcgtcgatgatggtggcgtggatagtcccatgagcatcttatgagtgttgaagtatctaacgagtcaggcttcgacgtttctgaagtggaactggttagcgtcgcgcggtttgtcatcatcaaaatggacgtcaacccagcagcagagctgtcgatggtgctactggacaccgcagcgatggccgatctacatatgcgctggatggaccttcctgggccaacggacgtaatgagcttcccgatggacgagttcgaaccgggtggtcgacctgacgccgctgagccagggccctccatgttgggtgacattgtgctgtgcccagagttcgccgcgcagcaggcggccgcagagggccacagcctcggacatgagttagcgctgctgacaattcacggcgtacttcacctgctcggctacgaccacggtgagccagacgaggagaaggagatgttcgccctgcagggcaggttactggaagagtgggtggccgaacaggtacgggcctatcagcatgaccgtcagaacgagaaagactgtcgattgctgtacaagtcagggtatttcggctacttgtgaccggcctgaatcagttgatcggcgtgatcgcgttgattggactgggtgggttgtttgctgccgatcgacgccgccattagcaccgtgtcgctggctcgggtgcaggagttagttcgcgaagaactatctgacgcgggacgactgttcaaggtgatagtcgatcggccacgctacatcaacctggtgatgtgttgttgcggatagcgtgtgaaattaccgctaccgtaatgctagtggtgttcctttatggcaaccttggcctgaactggtccttgttcggtgccgcgaccagccatggtggtggtcagctgcgtggttattggcgttggtccacgcaacttgggacgccagaacgcatactcgatttcgttggcgacagcacttcttttgcagtcgatctcatcgctgttgatacagatcagctgattgttggtagtcgtcggcaacgcgctcaccccgggctgcagcttgcgaaacggactatttgcgtacaagattgagctccgcgatgccgtcgatctggcgcagcaacgtggcgtggttgctgccgaagaacaccggatgatcgaatcagttttcgaactcgacgacacactagtccgtgagatgatggtgcctagcatcgcgatgatttggatcgaaagtgacatgtcggccactcaagtgacaaccctggccgtccgtagtggtcattcacatattccggtaattggtgagaatgtctacaacatcgttggggtgttttatctgagagacctggttcaacatacgttcttctttcctgatcacggtcgaggcacggttgtggcgcaagtgatgcttccggcggtgtttggttccggacttcaagctgttggacacgttgctgcgtgaaatacagcgtgactgtagccacatggcgctgttggtcgacgggtacgctacgatagccggcttggtcagtatagaatgaggttctggaagaaaatcttcggagatatctccgacgaatatgaccacgcgagacctctccagtagaattcttgggtggcaaacgtttccgcttttcagcttgattgccgatcaaagatgttggtgagctgtacggcatggaattcgacgacgatctcgatgtcaacacggtgggcggcctgctggctctggaattggtccgggtcccgttacctggcgccgaagtggtgtcgcatggcttgccactgcacgcttaaggcggcccggatctttgggggtgatgcggatcggcactgtgctgttgatcccagctgaatctgaaggctctgatggtgtgaggagtggttggtatggctgagctgctgaacactgaggatgccaagttggtggtgctggtgcgggctgcgatggcgcgcactgaagccggcagcggtgccgtagtgcgtgacttcgacggtcgcacatatgccgctgcgccagtgaccttgtcaacgctcgagctgatcggtctacaggaggaagccgccgccgcgttcagtgcgtccagtgtggtgagtgggttggaggtcggggtgctggtggctgggtccgtggacgagcccgatatagccatggttcgtgagctggcctcaacagcagtggtaatcctgattgatagaaacgggaaccgcgtatgacgacgactgtgtatttggcgcaaaatttggcggtagtccggatccgatttcccggttttctcccgcaagcggacggcctcctcatcgcgaggcgctatacggcgcgtatcgtctctggtggatatggctgaattccgttcgggtttcgtatgtttgatcggtcgtccgaatactggcaagtcgacactgaccaacgcattggtcggcaccaaggtagcgatcacttcgatgaagccgcaaaccacccgacacaccattcgagggatcgtacacagggagggtaacttccagatcgttctggttgacactcccggtctgcatcggccgcgcacgctgttgggtaagcggctcaacgacttggtgcgcgacacttataccgaggtggacttaatcggactgtgcatcccggctgatgaggccaccggtccgggagatcgatggattgttaaccagattcgatcggtcgccccgaaaacgatcctcgtcgttatcgtcactaagattgacaaagtgcccaaggaccggctgtccgcacaactggtcgctgtcagcgacctcgtcgccgactcagccgagatcgtgccggtgtcggctgtgacgggtgaacaggtcgacgtgctgatagatgtgctggctgcggccttgccaccgggtccggcttattactccgccggtgaactgaccgacgagccggaagagcttctgatggcagaactgatccgcgaggccgtgctggagggagtgcatgacgagttaccacattcgctggcggtggtgattgacgaggtcagcccgcgggcagggcgtggcgacctgattgacgtgcacgctgtgctttatgtcgagcggccaagtcagaagggaatcgtcattggcaagagcggtgcccggttgcgggaggtgggtatcgcggcgcgtcgccagatcgagaagctgttagggaccaacatctatctcgacttgcatgtcaatgtcgccaagaactggcagcgcaaccctaaacaacttggtcgactagggttttgaggtagctcaatcttgcgtggagctttgcggcgtgacggtgttctacaatacttccggccgcttgcttgcctagccgcaaacggcttccaggtcggcggtcagcgagatcagcatgccttcgctgtttgttggtcccatcaattgcacaccgattggcaacccctcggcggtgaaccccctgctggcatattgataaacggtcagctcagtacgttccacggccaagtcaccggagacgcggcggtcatggcacgatcaatgcgaaaagagcccaaccgattgaaggttcgtgccagtggtggtggttgtgcggtggtgggcgtcaggacgacgttgacgatgtcgaagatagaaccgacacgacgctggtcaacctcttcgtgtcgggccgcgcgctgcgcagaattgcttccccgagcacatgacctgtgcgcggattggtaacggtgcggcggtccaggccaatgccgtcgcccagccgtccctaccagtacgccaggccggaggtggaacgggcgagaaagtttcacgataaccgcaggccgtggtctgggttgccggttactacggtgtggacaagcagctcaaattgtttggctaccctgtgggtagcgaccaacatctcggggtgcaacttggcccgaaacccgtttaacgggaaccgagttgacatcgggatgttgagcgatccaggcgtgatgccaaggtagtctgataccgtcgtcgggcgtggtttgcgtaggtcgccctcaatgttgccggatgtttagtcgatcaccaatgccgggtcggccactgtgcagactagcacgccattgagcgtgatgccgctgaatgcctccggcaacggtcaggtggagatgcgaccgtgttgcggtttaatatccaccaggtgcgtacatgctgcagggagctggtcaccgccgccatcggaaccaatggcggcggtgaccaggaccgtaaccaccgcggccgcgctaccgccggacgatccgcttggtgtgtgttgacgttaccagggattgcgggtaggtattgaatctgggacccattagtgagtggctattagctgagttcataggtgttgttttgctgaaggtccctgtcccggccgtcttcaggtggcaaacgaattcagcgtcgtgggtggcgggttgtatatacccttcggcgccgaaggtagttggcattcttattatgtcgacgttatcgtggattgcaattgggataccgagtaacggcgccgtgtcgccggcggcccgtcatcggtttgcctgttctgcgtcggcccgtgcggactcggtgagcaccacatagaaagcgtccaacgcgggcttgctgatctcgatggcctgtagggaccggtgcaccaactcttgggcagtcgctgagtgtgtggccagttggtaaagcaagtcagcttagcgtgggtaggcgcttattgctggataaagaagctccaaccacaggttacgagactatcggcgcggatacccgagatatcgtggtgaggtgcaaaactgttgtgatgcgattgtatcgggactgggcgttagtgctgcgccagcacaacctcggcgaagccgaccggattgtcaccttgctgacccgcgatcacgggctggtgcgtgcggtggccaaaggtgtgcgtcgcactcgcagtaaattcggcgctcgcctggaaccgttcgcgtatatcgatgcgcaactgcaccccggccgcaaccttgatatcgttactcaggttgtctcgattgacgcgttcgccaccgacatcgttagtgactacggtcggtacacttgcgggtgcgcgatgctggaaaccgccgaacgtctcgctggtgaagaacgggcgcccgccccgactttacatcggcttacggtgagcgcgctgcgcgcggtggctgacggaaaccggcctcgcgacctgctgttagatgcctatttgctgcgtgccatggggatcgccggatgggctccagcgttgaccgcgtgtgcccgctgtgccacgcccggtccgcatcgggcttttcacattgccgctgggggcagcgtctgtgtgcattgccgtccggccggttcgactacaccaccgcggggtgtgctggaactaatgtctgcgctgcacgacggcgattggggaactgcccagcaagcgccgcagtcccaccgcagctacgccagcggattggtggccgcacacctgcagtggcatctggaacgacagctgaaaactttacctctggtggaacgaacacatcaagcataccaggtcgatcgttccatcgcggagcggcgcgcagcgctggtccggcaagatatggcctgtggttaggaacgagcgcacgctgaagtccacggattttccgcagctgccccctgcgcccgacgactacccgacctttcccgacaagtcgacctggccggttgtcttcccgatgctgccgccatcacccgacggcgggccgaggcgaccgccgcagcacacgtcaaaagctgtcgctccacggctctcggccgcccaattgccgactcatgtcgccatcgtgatggacggcaatggccgttgggctaaccaacgcggactgcaccgcaccgagggccacaagatgggcgaagcggtggtcatcgacgttgcttgcggcgctatcgaactcgggatcaaatggctcagtctctatgctttttctactgagaactggaagcggtctgtcgaagaggtccgtttcctgatgggttttaaccgcgatgtagtgcgacggcgtcgggagaatctcaaggagatgggggtccggatccgatgggtagggtcgcgaccgcgcttatggcgcagcgtcatcaatgaattggccattgcggaacacatgacggcgggcaacgacgtcatcaccatcaattattgtgtcaactacggtggtcgcactgaaatcgcagaagctacaagagaaattgctcgtctggcagctgcgggccggctcaatccggagcggatcaccgagtccacgatcacacggcacttgcagcggccagacatccccgatgtcgatctcttcgtgcggacttcgggggagcagcggtccagcaatttcatgttgtggcaggcggcgtatactgaatacattttccaggataagttgtggcccgattatgaccgccgtgacttgtgggcggcgtgtgaagaatatgcgtcgcgcaatcggcgcttcggaagcgcatagtgcactcttgacaagagcgactcgcattggtcctccgcgtcgtgttactcaccgaggaggaaaccgacggcgcgttcacggtgagaattcactgtacgttagctttgttgcgggtggttaatatcgtctccgacctcgacatggtgtcactcatttttaaatattgacgtgggatttgttgctgaaccaagaggatcagtgaccgagtggcaaggtgtacacgtgataccaatctcggtacggtgatcctggtcgggaaggtcaacgaataggctgcgcaacgtaactccgaaaagcctggcctcaaaattgcggacgtgatgctgaggtacaagacttcctggcgtcgtcctccaggacgttatcgacgatctcgtgtgctggtttaagtgaccagcacaccgatggacatcaacattgacgacttgacgtgacattgttggttccatccgacgaagctcaatctcaaggtggtggggtccaatttctccaaagcggaatcgttgcaaggctgcatattctgtcagcgatgtggccaactgattgagtgccgcgcgcgacaccattatttggatacccggcgacagcctgactgacctgatcgaccggggtcatgttatccggttctaggtcatcggtcttaccgctatacggctatcccacgaagctgtgtccagcagctggcgaatgtgaaaacgctatttcccaatggcccggcacggtccgggagtgatcatgtttcccacagatgtctgacgaacagtcctccattgtctgtggtgtgaggtcggcgaagttggcaatgtgggttgcatcaacgacgctgacaatcaacgatttcacgtcgccaagtgaatgacatgtccgtggtcggtttagccggagcactcgggtgtgaacaagccggtatgccaatcgcagggccgcagatgatgaaggccgatctacagttagacgttttatgaatcaacgacaatggccttttaatccatctcgccggaatgcttacggcttggtaagttgaatctgttggtttcaatcgtgatgcacgctttctgtggaccgttgtcctgggtcggtcaggagttttggcattatggcccgggcatcgtcgctagcaaatgctgtgtttcaaccgtattgggtaagggcgtccggatgcaatgctgagacataagttcagacgattagaccatcggcgcagttgactgggctccagcatgactatggaggtcggcgccgacgtcgttagctggtgatatcggctagtctggactgcgctcgagtttggtcaatgtcgacctcgtcgtagcagggtgcgttggcttcgagtgctgcctttagccgaacgcagaagccgcaccacgacgttgtgtaataacatagttaaatgtaacattggccacataaatagttaacatagctttacgactatgcgggcttggtgagcaggacctgacaccgggcgaggcaacgggcttggcgatgtgcaaggtttctcggtcttggctgccaagatggatcctatggtaatggtcgtaaatccattgactgctggactggatgacgagcagcgcgaggccgtgctggctccacgcggacctgtttgtgtgctcgcgggagccggaacgggtaaaacccgcaccatcactcaccgcattgcccaccttgttggtgctggtcacgtcgccactgggcaggtgctggcggtgacattcacccagcgtgcagcggcggagatgcggtcccggttgagggcgcttggcgctgccgtacaagccgtttcggattttggcgttgtgcgagtcctgacctttcatgctgccgcgcaccgccagttgcgatatttctggccacgggtgatcggtgacactggctggcagctgttggacagcaagtttgccaccgttgcgcgggcggctagtagtgtcaggctgcatgctggcactgatgacgtgtgtgacctcgccggcgagattgaatgggctaaggcctcgctgattgggcccgaagaatacgtggccgccgtggccgctatcggtagagacactccgctggacgccgcgcaaatcgcgagtgtctacgctgcctacgaagctcttaaggcccgcggcaatggcgtcccaggggtcacgctgctcgacttcgatgatctgctgctgcacaccgccgccgcgatcgagaacgacgcagcggtagccgaggagttccgggaccgttaccgttgttttgtagtcgatgagtaccaagacgtcaccccgctacagcaacgggtgctttcggcctggttgggtgatcgagacgatctgactgtggtcggcgacgccaaccagaccatctactcgttcactggggcttcaccttgtttcctgcttgacttcccccgacggtttcccgatgccacggtggtgcggctggagcgcgactaccggtctactccgcaggtggtgtcgcttgcaaatcaggtgatcgcagcggctcatggccgggttgcggacagcaaatttcagctgtccggccagcgtgagccgggtccggccgcgtcatttcacgagtattctgatgagcctgctgaggccgctgccgtggcagcatcaattgctcgactgatcgaattcggcacctcgccatccgagatcgcggtgctttaccgggtcaatgcgcagtccgaggcgtacgaggaggcgttgaccgaggtggggattgcctatcaggtccgcggcggcgagggatttttcaaccgccaggagatcaaacaggcgctactagccctgcagcgtagtgcggagcgcagctcccaaacagaaccgaacagcccattgtcggacgtggtcccggtgttctggagccattggggctaacggctgagaaaccggtcggcagccgcgcccggatcgttgggaggcgctgaccgcattggccgaactggccgacgacgaagtggctcagcatccgcggctggatcttccggggttgctggccgagctgcggttgcgggccgatgcccggcacccaccggtggtacagggcgtcacgttggcctcattgcatgccgttaaaggacttgagtgggatgcggtgttcttagtcggattggccgacggaacactacccatctcgcgtgcgttggcgcatggtgctgaaagcgagcctgtcgaggaagagcgtaggctgctttatgttggaatcaccagggcccgagtgtatttggcacttagctgggcgttatcgcgaactccgggtggacgtcagagccgcaagccgtcgcggttcctcaacgacatcgcgccacagatgggtcaaaatcctgcgtcgagcagatctcggcgtaatcggaccgctactttgcgctgccgtatttgcaaaaacgacctgaccacgcctgcggccgtcatgctgcagcggtgtcagatatgtgccgcagacgttgacgaagaattgttgctgcagctcaaagcgtggcggcttagcactgccaaggaacagaacgtgcctgcttacgtcgttttaaccgataacacgttgattgcgattgctgagttgctgcccgccgatgaggccgcgttgatcgctgtcccgggtatgagtgtacgcaaaattgagcaatacgggtcggacgtgctgcagttggttcgctgccgtgccgtcgcggttaggacgcagacctgatcgatcgtacctagttaactgatagcagacaaacgcgcagataaaaataagtttccactgctggctgttaccgttgtgctcaaatccgcgctttgctggccgtctgaagtcaggtttgcaggcaggcgaaacggatatatggagggtagccacggtgattgactacaacaacgtgtttggtgcgggcgtggttgcagctgtgtcgaccgcgggaacccctcatgccgccacatcggctgcagcgggtcagtaccgcgtagccgcgacaggaacccgtccgtggatcggggctatactgaactacgaagtcagcccgattttcgccagatggccacggaaccgaaatcaccaggatccgtggcacagtttttgggcaaatagcctcccaacctggtacagatcctttttgaagaaagacagccaccagaccaggaagcagatgaaaaggacatgttgacactgacaatccctaaacagacgctgcccgggttgccgtgccatgccgacacctccgacctatggttcgctgagaccccagcagacctggagtgcaccaaaacgctctgcgcgaactgcccgatccgccgcccgtgcctggaggcagcgatggaacgggccgaaccctggggtgtgtggggcggtgaaattttcgatcgaggcttgatcgtgagtcgcaaacgtcctcgtggacgaccgtgcaacgatgtcgtcgttgtttagagaaacaaggtcacgaaagtgcaattgtcgaattgttccttgaagagacggcctcagtagtggcacttttggggcgttagacgatggcagtatcgggctcggcgaagccgggaaccaacttctcggtcagagccttggtcggcacatgcgcgtcgagttggcagaggatcgcgcccaccgacgcgatcacccgcataggcagggccagtgtagccggcagatccaactggcgtgccgtcttgatgtgcgacaccgatcggtctaggcttatctgttgcagccatttacgtgtgtagtggaaaacctcgactttgatcggttctacgtactggtgcatcatctcgtcaatgtcgcgcacagacacctgtcggcctttttggattaagccggccttctccatcgtctgcagcaagaggttgtagttcttgtcccgggccaatcggatgctcattcccagctctaccgggaaaccaccaggcagtggcgcgatagcgccgaagtcgatgacgcccatccggccgtcggacagcagcatgaaattgcctgggtgagcgtcgccgtgcagcatttccaatcggcgtggcgaatcgaaggtgagttcgagtagcagttttcccatacggtcacgttgttgggcggttccgttacggatgatttcggccatcggaacaccatcgatccactcctggattatcactttcggtgcgcttgccaccacgtttggcaccacaaagcgcgggtcgccctgatacgccttgcgaaagcacgttggttgtcagcctccaaccgataatctagttccatctcggtgcgttcgactaattcgtctaccacaccttggatgtcagcaccgggagagagctgtttgagtatcccaaccatccgctgcatggtcttgagatcggcgcgcaacgcctcatcagcacccggatactggattttgaccgccacttcgcggccataggaccataccgctttatgcacctggccgatgctggccgaggccaccggggtgtcgttgaacgagctgaaccggtcccgccacttggtgcctaactgggcgtcgagcacccgatgcaccttgttgaccggcaacggcggggcgtccttttgcagcttggtcagggcttcgcggtagggctcgccgtactcttcaggaatcgcggcttccatcacagacaatgcctggccgaccttcattgccccgcccttgagctcgcccaggacactgaacaactggtgggcggtcttctctatcagcttggtgttaacctcgtctttcgacttgccagtcagtcgtttcccgagcccgagcaccgcccgcccggcaaggccgaccggaatgctagctagcttcgcgttgcgcgcagcctgaccacgtttgatgtctgccacacgtctatcatccatgacggtgaagcgtgccatggacgtgatatggcaatcaatgatcaaacggctacattcattattcattcgggctttcacccgcatcatccagcgtcgagccaattttctccgtgcaggttcaatcttgtggttcattgaaacgcatgttcgaagggtggtaccgaaaagccatggcagtaaagcaaacgtaacacgatgctctaacggatatctgctccattggtgcgcgacgatagagccggcgcccagatctcgaactccagtgtggtgttcaacgccgagggtggtccggaaccgagtaacacctcctgttagtacaccgcgacgatcactcgatccaccgggcttagcgtcagtgccgcggtggtgagtggggtggcctggttggccaccccgatggtgtcttgcagctgggcggcgaacgccggccagacggtgtcgcagtcgctgccgtgcaggtctgcacaggcttggcagctagttacgccggtaatgaccagcagccccatcaggttaggcctcgtgccgttacggacgtggaccggaaggtgtccgatacaccccggctatacaaatcgcacaccatgcgcgggtcagcgaccaggtgggtacgaaaacgactaccaggtccactgcggaagtgactggtatgcatattggctggctgtgcgttatctcgggctcgagagcagtgtagcgtctccaccagcaggtctgacagcggggccgcggctgtccggccacgggactgccggtatccgcgggttgcgacaccggcaccaaaactagttgcgcgacgaggttcgccgggtcttcggggcggccgacttccatatgcccatatgccggcctgcccctgcaacttggctatcggtgtcgattatcacatggattgattgcagcagcgcgactaactccgccgcggcggggccgtaccggtgggtggatcagcgcggtcctgcggaagatctcaaccgacctacaccgcgccgtccggccggcagcagcaccggcatggcatcgcggggtccagcgtatagaggtttagagcgcagtttccggcatgactcgagactttagccatgccggacattcaagtctcgatcagttatccacaggaccgccagagccgggggtcctaccatcggagttgccacggtctagatcgagtttggcgatcgcttcgtcgatgccgctggtatcgccaccgatgattcgatcgatgaagctggccgggtcgtcgagatcctttccagagggcagcagatccgggtgttgccagacagcatcacgggcgtccacgccggcagcttgggtcaagcgttcccatagcacggcagcctcccgcaacttacgtggccgcagttccaagccgaccagcgtggcgaatgtctgttcggccgggccgccactggctcgacgtcggcgcagcgtctcgccgagcgcggcagcacctggaatccgatcgcccagagccgcggtcactactacctgcacccagccctcgatcagtgccagcagggcttctagccgttccagtgcctgagtttgtgctggggttgcctggggttcgaaaacaccctgacccagcagctcctctatggcggtgggatcggacagcgaggctggattgaaatcgcgtgctagctcctcaattccgttcatgtcgatcttcatacccgcggcataggcttccacggcgcccagcaattgactggccagccagggcacgtggctgaataagcggtggtgtgcggcctcacgagtggccaggaatgtcagaatctcgcaccgcggctgttcgagcccatcggcgaaggattcgacagcttgcggcattatcgccgctacgcccctgggtcccagcgggagaccgatatctgtcgatgttagcacttcgcgggacaattgaccaaatgcctggcctagttgcgaaccaaaggccatgccgcccatttgcgacatcatcgacagcagcgggctggccatactcttggcctcctccggcagtgacgctgcccacacggtcgagatttgttgggccatcgggtcacatagccttttccacgtctccaaggtgttgttgacccagtcgtcgggggtccagccctccgcttttgtggtacccgcgggcagcgcggtgaccccgtccagccaggtctcggcgagatgtaccgcatcgccgattgccgagcttgtggttgccgggatgggcgcgacaaaccctattgaactcgacgcgactcgtcgcgccaattcataattgactggaccgagttgtttgtccgcggtcattgcggtgccagcgttggtgaacatttgacccaggtgggtgaagatctgtcccaggtcgctcatgccgaagtctccactcataccgaacgaagctaacgggtctgatccgctcgagccggaatcggggccgttttttccgtgcttgtcgcgtcccgactcgtcgtttggggagtcgtttccggaagagaagccgaaaggtgggttagccacaccgtcaacggtactcacaggtgagccagaatgcgccaccccgggtcatgcttatagctgaacgagcacgatgaaatgagagtacgtctaatctaagcggcgtgaacaggcggattctcaccttgttggttgcgctggtgccgattctggtcttcggcgtgttgcttgcggtggtgacggtgccgttcgtgtcgctgggccccggtacgc

SEQ ID NO: 130 - DNA (genomic), 36941 bp, MYCOBACTERIUM LEPRAE; double-stranded, circular
  hypothetical: NO
  anti-sense: NO
aagctcggacaactccggttcgctaaacgtgacgcttccgatatcgatcagcaagcaagccagtgcccagcgaagtggtatcaaccctaatcggccagtggccgccagtgccgcctcagcgacgacgcgggcgcgctcagtggcggcgctgcatagggcggcggccagcacgacatcacttttgacctggtgccgcaccgacacgactctcccaacctgggccagttcaaccgcttcccgggcgtgacgcacagcagtcgccccgtcacctacggccatcgctaattcagcggccacccagcgccgacgcaccgccaaccggtccgccacctgagccggcaattgtgccggagctagcgccgagcctacgcgcctcaacaatgtcgccgcggcggccaaacggccgacgccgagcgcgtcggccgccagcccgatcaatgcatcggcacgagcctcggaatcggtgccagccagcaccagggcacgaccatcccaaccccgcgccaacgagtgccaaccgagttggcgcaagaacgatccgtgtgtactgtgcgccagcgaggccagcctcccggccggaacgctgcgtcgcaacaccgccaggtcgcggtaggcgctgctgtagtgaccctgcccaccggccgcaacggctcgcaaccacagttggtgaggtgtagtagccgtcggcaacggccaacggcccggctggtttccaaaggcagcggcagcaagcattggctcagccgccgaagtgtgaccaatttcaaccacaatgctaaccgaggtcactagtccaatctgtgtagtgtctacgttaccgaaatattaacccaggtccacccgtagcctaattgccgaagcctagacataaggactcggaactggaaaaacttggcatcgataggctcctccgtacagcaagttttacattcggcgaaaacgtcggagatgaacgcagtattaattctcgtgcaacccttacacattttgccgcggagagtggctattgactctaattcgtcagcccacttaccgtctaatgttgtcgggtagtcatcgatgacgccactccaaaatcagtgtgcacactcacgtacgtttgtgaacccaccctccacttgggcgtaccgtgcagagagggaatacgtaatgccacagcctaagcagctacctgggcccaacgccactatctggaactggcaactgcaaggcctgtgtcgcggcgttgattcatcaatgttcttccatcccgacggggagcgtggccgtgcccgtatgcaacgcgagcagcgcgctaaggaaatgtgccggcgctgtccggttatcgaggaatgtcgtgctcatgcgctggacgtcggcgaaccctacggcgtttggggcggtttgtccgaatccgagcgcgacctactcctcaagggcgatctcgcgcgcagccgcagtatccctcgcagcgcctaataaacctggcttggaccagcaccggttgcaagccaccctaggtcaacctaaattgcgtggacgctaatccgtcggtagcgtcgcgcgtcctggccgcgtttaccacaggtttccgagcaccattcgcggcgagggtgagatctgacaaaatagacaaaatatataccacgcatccggggccgtggcaggtgcgcagcttgatatcgctgggtcctgtgaacatgtccaatcgagtcacgcgcgagttcggctaaggcgacgcgggccagtgaaataggcaccggacgaccgtggtgcagccgaccccccgaataacgagttgagtgtagggcagcttcttagctgccaatcccccaggtcaacagcgttgccgatgctgttgacctgggggattgggcagccagtcggagatcggctatggcgaaagcgggtaaccggcgaagggagtcctcgtaacagcttggccccggccagctcggcacgacgggggtctccgctaactttggcagcgtattgccctctgctgtgaaaccgaacgcatatcaactagaaagacccccggtatccgggggtctttctaggggtacgcactggctgtttagtgcgcatggccgtggtggtcatgctcttctgtcttggccggcttgtccaccaccgccgtttcggtggtgagcatcatccgcgccaccgaggccgcgttaagcaccgctgatctggtgaccttgaccgggtcgacgacaccatcggcgaccaaatcgccatagcccagcgtgctagcattcagtccgtgcccggcgggcagcccgctaaccttgtcgaccaccaccgcgccatccaacccggcgttagtggcaatccagtaaagcggtgccttgagcgcctcgaaaaatacgtcgatgccgagggcttcgtctccggtcagcgacgtacgcaattgcttgagcgccgcgccgcactggacgagcgccgatccaccacccgcgatgataccctcctcgatagacgccttcgcagccgcgacggcgtcttcgacgctttccttgcgtttcttcagcgccgtctcggtgacagcccccaccttgatgacggccacgccaccggccagtttggccacgcgctcctgcagcttttcgcgatcccattctgagtcgctgacctctatctcggcccgcagctgattgactcgcttggccaccgcgtcgttggaaccgccgccgtcgacgatgatcgtgtcgtccttactaaccaccacacggcgggccgagcccagcacgtcagtgcccacctcgcgcagcaccaggccggtttcggggttgactacctgaccacccgtcacaattgccaaatcttcgaggaaggccttgcgtcggtcgccgaagaacggggacttaaccgcaaccgccttgagcgtcttgcggatcgagttaacgacaagcgtcgccaatgcttcaccctcgaggtcttcggcgacgatcagcagcggcttgcctgactcagtgaccttctcgagcatcggcagcaactcaggcagcgagctgatcttctcctggtgcagcaggaccagcggatcgtcgagcacagcctgctgcgagtcgaagtcggtcacgaaatacgccgacaggaaacctttgtcgaagccgacgccctcggtgaactctagctcggtgtccagcgtcgacgactcttcaacgctgacaacgccgtcagtgccgaccttgttcatcccctcgccgaccagcgcaccgatctgctcgtcgcgcgaagaaaccgtcgcaacctgcgtgatggcgtccttgccggccaccggggttgctaccgccagcagtgcctcggacaccgcgtcggcggccttgctgatgccagcacctagggcgaccgggttggccccggcggcgaccatgcgcaggccgcccttgaccagcgcctgggccaacacggtcgcggtggtagtgccgtcgccagcgacgtcgttggtcttggtggccaccgacttcaccagctgagcgcccagattttcgaacgggtcctctaggtcgatctcacgcgcgacggtgacaccgtcgttggtgatggtgggcccgccgaatgccttggccaacaccacatgtcgaccgcgcggcccaagtgttacccgcaccgtgtcggcgagcttgttcatgcccacctccatggcatgacgcgcggtttcgtcgtactcaatcagcttgctcatcaggctcctttaaacgcatgccgccccggaaatcacccgtggttaagcacggggatcgccggggcggaacacggttcgttacttggatacgacagccagcacgtcacgtgccgacaggatcaggtattcctcgccattgtacttgatctcagtgccgccgtacttactgtagataacgatgtcaccctccgacacgtccaccgggatccgcttcgcgccgtcttcgtcccaccggccggggccgactgcgacaacggtgccttcctgcggcttctccttggcgttttcaggaatgaccagaccggacggggtcatggtctcggcctcgccggcctgtacgagaatcttgtcctcgagtggcttgatcttcaccttcgccacgattggagccctccactatttcgatcgggcccgggacctgcgtcccggactgtgttggtagcgggttcgggacgcaggtcccggaccggcacttggcggtcggtccagggcttaccccgaaccgaccgaattatcaggtgattcggcattcgcccgtaccctcgcatcgtcgtcgcgggtgccgacactggggtctggccgactgccatctagcactctatacacgcgagtgctagcactcaaggccggcccgctgcttcctggctgttggcgtgtctagctcaattaatctgcctttttaccaccggaaggcccgggtcgctgggcacatccaacggtgacggtggcgcggccgcagccagcagatgtgcggcgaacgcggcgatcatcgccccgttgtcggtgcagaaccgcggccctgggatccgcagcatcagccccgccgccgcgcagcgctgcgcgctagctcgcgcagcggcaattcgcggccactcccccgacgatcaacaaagtggaaacgccgagcccggtcgccgcacgcaccgccttcatggtcaacacatcggcgacagcctcctgaaacccagcggcgacatcggccggcagcgcgtcggggtgactctcgacatatcgtgcgacagcggttttgagccctgaaaagctgaacgcgtttaggtcgtcggccggcccagtcatgccgcgtgggaacacaatggcatcccgatcgccggtacgagctaggtcgtctagcactttaccgcctggataacccaatcccagtaggcgcgcgaccttatcgtaagcttcaccggcggcgtcgtcgacggtactgcccagctcgacaatgggcgccccaagtgaacgcacctgcaacaggtgggtatggcctccagacaccagtagcgccacacactcgggcaacggtccatgttcgtagacgtcggcagccaggtgtccacccaggtggttcacggcgtagaacggcactccccaggcagccgagtacgctttagccgcagccactcctaccaacaaagcaccggctaacccgggccctatcgtggcggctacaacatctggcttggccgaaccggtcaggccggcagcagcaagcgcgcagcgtatggtggggccaagagcctctagatgcgcccgtgaggcaatctcgggcaccacaccaccaaaccgggcctgctcgtcgacgctggaagccacctcgtcagccaacaatgtcacggtgccatagtcatcgaggcaggcaataccaacaccggtttcatcgcaagaggtttcgatggccaagataatcgtgccgggcacagcagagatcgtcattgcgcctcccttcgcatgaggtaagcatcggcaccgctggctgggtagtagcgggggcgtagaccgatccgttcgaatcccacactgcggtataacgcaatggcggtctcgttgtcggtgcggacctccaggtagatcgcaccactaccggcgaaatccagcagctcacccagcagtcggcggccgacaccgcgccctcggtatgccggatctacagcgatggtgtgcacttcgtattcgaatggaggggtgtggcccaagcgggtgatgccagcataaccgacgagcgtgtcagcagtgcgtgcacccacgtaacagttatatgagttggccagttcgcggtcgaacgctgcagccggccatgggttgtcgccgtcgaagaactggctttccagctgggcacaccgatcgacgtcggcgggtgtcaacgtaccgatgactatgggctcgttgtcggcagtaattggcttggcatccggccgacgcaaatacaacgctaccagtgggatcggggacaccgaccagtcaggcactgcggctaccaagccagccggcgtcgggtagatcggttcgcacagtggcaggccgaacagcgccgcgtgctcaggcgagccggccaccgtcagcgcggtgccgggatcgacatcggtgggagagccgacggcaggaccggcgatgcgaactccgtctcgataacgggcccaataaacctcgtggcggcgcgcatcagtaaccactagcgtatcgccggtggttcgcacaccaatagcgtccagactgcacacaccatgcaccggaatgcccagcgcatgcccgtaagcagcagcagttgccatgccaacgcgcagaccggtaaacggaccaggaccacagcccaccaccacggcgtcgagctcacacattgccaactcggcatcagcgagagcgaccaacacgttcggcgtgaggcgttcaacatgcgccttggcgtcgacggtgacccgctcggcgagcgtaaaacagtcgtgaccatcgaatgccacgatgccggccgtcaccgccgcggtggcggtgtcgatggcgaggacaatactcatggacggtcccgggaacacacccactgccaggtagcgatacgcacatcggagtatctgactcgttcgagacgaatgtcgaggtgtcgcgcagctagacattcagctagacccgcaccccactccatcaccaccaccgcttcggcgagatcggtgtctagatccaatgagtcgagctcacccaccagatcggcatcgcgatggtccaacagccggtaaacatcgacgtggatcatcgccggggtaccgagccgtcgcggcaggtgcacccgcgccagcacgtaggtcggcgaaatgaccggaccgtcgacatccatcgccacggcaatacccttggccagcacggtctttccagcacctagcggaccggagagcaccaccacgtcacccgcgcgtaactgttcccccaaccgtgaccccagcgcaacggtgtcctcgacacgttcgcagatgaccgctcctgatctcaggctgtactcagccatggcgctgtaaccgttccttgaatcgccgatatcgcaacgccgctttgcccggaacagctcggttgaccagccgaaccaaaccgtcgttaatggcaccgggcttgtccagcagcgctaaacggctggccccgctgacgatgaccagcgccaacagtggcaacacggctgccattcccctagagcgttcatccgacgtaagcaggtcgtggtcaccgcacgcaatcagggccgggaccctgagcaatggccataggccagcggtttcttcgtggagttccaaggcatgaagaaagctcaccaggatggctatcaaggtgtcgttcatgatccgctgggaaaacgcgtctaagcctcgactaacccgcagatcgctataggacgcggctcgcagaatcggaccaatcagtgattgtgacgcgatgctgccgcggtgcatcagcttggacgccgaccgagaggtgagccgaactgcttccagagcagggcttttcagtattccttccatcgaatggccgaccaatacgatcatcccatgcggcgttaccgtctgcagcactgttcgcagatcctggcccagttgggtcagcgtgtaggtatccagtgcaacttcgctggattggacgtggccgcagtggtcgtagaagaccatgcgcacctgtggtccccatcgcttgccgaaccgcttccgctgaaagtgaaaggagtccatacgcaaatagaatccataggcgaagaccatagccaccggcgctttcaccgctccttcctcgcgcaccaccagcgccattccgccggaaatggtcacccaacagcgacgttcgtcgccgagcttctcgaaatcccgatcgacataaggatctctgcatgcattgtcgcgttcaaatatcgatcggagcgacaaggctccgacgatggtggcgaccgggaccagcccggtgcctcccgcaagccaaggccggccgttccgacgcctgcggatttcatcatctgtcaacggtttgggcctcgcggtacgttctggtgatccgcccgcgtagactggtgaccacttcatagtggatagttccaagcagatcagcccaatcttgcgcagtgggttcgcctctggcgccgggaccgaacaagatggcttcgtcgccttcggctacatcgattggccccggacccaagtcgacgacaaactggtccatacagatccgtccgacgccaggccggcgcttgccattgatcagcacatccagccggccgcccagcgaccggaacacaccgtccgcatatccaaccggcaacagcgccaaattggtgtcatgctgcgcaatccagtcgtgtccgtacgaaacaccttcaccagcacgaatagacttcaccatcgcaacagcgcatttcaccgtcattgcgggtattagtcccatatcaccgcgggaaggcacaggactaagaccgtacaccgcgatgccgggcctgaccaggtcgtaagccaggtcaggacgagacatcgtagctgatgaattcgacagatgcgccacctcgaaccgcaatccctgttcgtgcgcctgagcgagcagagcagcaaaccgcttgccctgaacgtcattgctgggattatcgggctggtcagcgtaaaccaagtgcgacatcaacccgcgcagccttacggcgtcttctacgacagcccgctgcaacgcggtcagcatcgccgggtattgatcggtgacgaccccgttgcggttcagcccggtgtcggctttgacggtcaccgtcgccgtacgaccggtccgacgcaccgcatccagcagctcgtcaagctgacgcaccgaggacaccgctatctgcacgtcggccagcagcgcgggcccgaagtcgattccgggtggatgcagccaggccagcaccggtgcactgataccgtccgcgcgcaatgcgagcgcttcgtcgacggtggccacacccagctcggccgcaccggctgccaatgcggcgagggcaacctgggtggcaccgtgaccgtaggcgtcggctttgaggacaaccatcagttgcgccatgccagcgtgctcacgcaacacgcgcacgttgtagtcaatagctcccagatccacaacagcttcggccaagacacctggcctcaaggatatcggtgtaacagccaaaataaacgtgctcctatttagatgtgtgtcaactcgctgccgacattttcccagaaccaatggggcatgccgatccacgcgtgtcgattacggagcacaactgtatctaatgcacgaagtggtcggcgctgtagtgtccgccggacttgagcttatccaggggtcacccgagagcccttcccagaccacgatgcgcagcaccgatacgtcagtggcatcgtcgggcacagttataggcgggcacctgccaaccgaatgtccggagttcgtggaggagatcgaactcggtgtacccacagtctctaacgagcaaggaggtataccaccaggatggccgtgcggtgtctgatagtccgatgtaaccgatcagctcacaatagtcaccgacgcggagctactcaatcagccaccgcaccgtcagcgacaaggcctgcatgactttccagtaaccgttacgtcccagccacagaaagttgtagtactgactaaccacttggttgtccaggcgggaaaagttcaatacgaaagtctacatatcgccgcccaggtagttgacacgaaagactacgtcctcgggcaaatattcgttgccgcgccatacgccaaatcccacaccggggtagggtgagcccatatttatagccactttacattgatcgacatcactcggggcagccaggaatcccacttcaactccgggtgcaagcaaggcatcccgaacccccgctggcggcaccgacggacactgcaatgtccaagccattgtcggctgccagcttgtccagcgcgacgcagagctccgcgacgggttcgagttcgccggtgaaagtggcagacaaagatggccacgacaccaagtagtgtcctcgtcgacgggcctcgattacctgctcgggaggtgatgacgtagcatccttcctccatcgacagatagcggctcgacatcgaagtaacgacagaacttctcccaaaccacctggacccctgcgcccatccccagattgggggtgctacgctgctaactagctaccgcacaccagcgcaattttatggccaggcaacccagcatcaccacccatccctggagccgataatggaacaccccacaggtattggacgggttgtcgtagctgagtccctaggcgtgaatagagaccggtcgccatgctatacgcagcgccgttcgatggcgcggccgccggatactcgtccttgtctaaacatgttttgtcgaacgtctcggccatcaacttctttacctcgggatccacccaggtggtgacgaaagtagcgctaggttgagccgagaactgccgtctaccattagctagtcgtgaataaagcggtacgccgcctcaggatccatcgatgcttcgggcagccaccagacagaagagggtggccgatgccgtgaacatacggccggtgtaagctggaacgatcaagtcccggggtacagacgggtgactgggagatacgacggatcctttacgtttgaccgttgctgctataaggccgccagggcagttcggatgtgcgacaccatgcgggacgtgactgtggcacgtcaccaggacctggatcagcagccgacagcgctcgcgcacgcgcgtgcacgaatgccgcggcgcggcctcggcgcaggcagccccgcggccagcagcgcaccgatcatgccggacagcacgtcaccagacccggcggtagccgcccaagactgtccagccggattcagatataccgggccaccgggatcggcgatgacggtgacattgcccttcagtagcacagtggcgccgaaggaatcggctagcttgcggcacgcacctacccggtcgtcgcctggcggagtcccggccaatcgggcgaattcgctggcatgtggagtcagcactgtcggcgcgttgcggttgatcaccaggtcggggtgagcagccagcatggtcagcccatcagcgtcaacgagcaccggcaagtcagtttccagcgcgaaccacagtgccgctgtcgcggcatcgatacccagccctggcccgacaacccaggattgcacccgcccggccgcagttggggtggccgatgcaataacttcgggccagtgcgcgagcacctgggtataagcgctaccagcatagcggaccatgccggaggtggccgcgaccgcggcaccggtgcacagcacagccgcacccggataggtcgacgagccggccagcacgccagtcacgccttgggtgtatttgtcgtcatggacaccgggcaccggccagtacgcggccacgtcggcggcctgcaagcccaagatatcggagtctggaaggtcaagcccgatatcaaccagtgtgacgtcgccgcagtctgcgagcgcgtgcacgggcttgagcccgccaaaggtaacagtcaacgctgcgtgcacagcggggccgttgattacgccggtcaccacatcaatgccgctggggaggtcgacggccactaccggtacccccgaggctgagacagtcgcaaacaccgcggcagccgccggtcgcaacggccccgagccggagatgcccaccaccccgtcaataacgagatcagttgctgccgatacattttcgacgatacgaccgccggctttccggaacgcaaccagtgccttgcggtggacgcgatccgggttgagcagcaccgcatcggcagccgcaccgcgcggcgcaggaaagtcgccgcccacagggactcgccgccgttgtcgcccgagccgacgaccgcacacacccggcggccggtaactccaccggtacgaacggccagttcacgaatgatcacgctggccaacccgtaagccgcgcgcttcatcaacacaccgtcaggcaggctggccagcagcgatgcctcggcgtcacggatagccgctacagagtaataatgccgcatcaatacttatggattccatgctcgcgtcgttgcgcatttaactacagagcgtacagttgcgccggattgaagttaaataaatgcactagccatcacaccgaagcgcgtggaaaggggcaaacgtagcacagactgacgacgatacctgggacttggcaaccagcgtgggagctatcgcaaccaacgtcacggtgagacgcgcactggccagccaagcaaccaaaacgcttatcaatgaccccttcagagaaccgctggtgcatccagtggatgtggtcggttggcacccgagtatctagtcgatgccagccacgcattgccgacatcgctaccacccagcgccagttactcaacggtgacggacttggccagatttcgcggtttgtcaacgtcgtagccgcgagcctgcgccacagacgcggcgaacacctgcagcgggatggtcgacagcagcggctgcaaaagtgttgacaccgcggggagttcgatcaggtgatcggcgtagagacgtaccgtgtcgtcgccttcctccgcgatcacaatggtcaccgctccgcttatctgaatttcacgaatgttgctcagcagcttagcatgcagcatcgccgatcccttgggcgagggcatgacgacgattaccggcaggttttcttcgatcagcgcgatgggtccgtgcttgagctcgccggcggcgaacccctcggcgtgcatgtaggccaattccttgagtttcagcgcaccttccaacgccaccgggtacccgacatggcgacccaggaacagcacggtcgtcgactgagcgaaccggtaagccaaatcggccacggggcccatccccgcgatgacccgggccaccaggtcgggcatcgcttccagctcgcggtactcgcgctgcacctcatcggggtacttagtgccgcgggcctgcgccaacgccagcccaaggaggtagttggcggcgacctgagccagaaaggttttcgttgaggcgacgccgatctccgggccagcgcgagtatacagcaccgcgtcgcactcacgtgggatttgggagccgttggtgttgcaaatcgccagcaccttggccttctgctctttagcgtgccggacagcttctaaagtatcagcggtttcaccggactgcgaaatggctaccaccagtgtgctgcggtccagaacaggatcccggtagcgaaattcgctggctagctccacctcaacaggcagccgcgtccagtgctcgatcgtatatttggccaacaagccggaatgataggcagtaccgcaagcgaccacaaacaccttatcgatctcgcggagttcctgatcgctcaatcgctgttcgtcgagcacaatccgtccaccagtgaaatgcccaagtagcgtgtcgactaccgcgtcgggctgctcagcgatttccttgagcatgaagtactcgtagccgcccttttcggcagcggccaggtcccagtcgatatgaaatgtgcgagcgtttacagcgtcatcgttgccatcgaagtcgctgattcggtaaccatctgcagtgatcaccacagcctggtcctgaccaagctcgaccgcctgccgggtgtgttcgatgaacgcggccacgtcggaaccgacgaacatctccccgtcgccgatcccgagcactagcggggtggagcggcgcgcggccacaatggtaccgggctcgtcggcgttggcgaacaccagagtgaagtggccctgtagccggcgcagcaccgccagcacggacccgacgaaatcaccggccgtctcgccagcgcagtaagcctgtgccaccaaatgcacagctacctcggtgtcggtgtcgctgacgaactctactccggcgatctccaactcatggcgaagggaggggaaattctcgatgatgccgttgtggacgacggcgatcttgccggtggcgtcgcggtgcggatgcgcgttgcggtcggtggggcgaccatgggtggcccaccggatatggccgaggccgacgttgccggccagcgacgccggaaccatctccgccaacaccgactccaaattggaaagtcgaccagcacgacgacgaacggtcagattgcccgatttggcactgccgttgatcagcgcgattcccgacgagtcgtagccgcggtactccatcctgcgcagcgcatccatgacgaccccgcaggcagggcgctgcccgacgtagccgacaagtccacacataaccctgtcagggtagtgcagccagtgcagtagacaggtacacagggctgatcggtgcagtgtatggattacaagtcacgttaacctaccggccaattcgccttagcggggcaatccgtaatacggacagcatctgccggtcaccaatcagctgttacgagccagtgcgctaccgtcggcaggtggcccacacccgcaaactcttagcagccctcagccgccgtggcccgcaccgggttttgcgtggtgacttgtccttcgccggtttgccaggggtggtgtacaccccggctgggggtctgaatctgcccggcgttgcgtttggtcacgactggctcaccggtaccgcccgttacgcgggcctgctggaacatttggcgtcgtggggcatcgtgaccggcgctcccgacacccaacgaggtctcacgccctcggtgctcaatctggccttcgacctcggttcggcactcgacatcgtggcgggtgtgcggctgggtcctggcaatatcagcgtgcaccccgccaaactcggcctggtaggacacggtttcggcggatcggccgctgtactcgccgcagccgggctgccaggcttggccggtttgccggccaaatccgcagtggcgatcttcccgacggtcacaagtccagcgcccgaacagccggccgcgacgtgcaaggtcccgggtttgattctgaccgctccaggagatccgaaaacgttgaattcaaacgctctatcactgtaccgcgcttgggatgatgccaccttgcgcatcgtcagcaaagccaaagccggcggcctggtggaggggtggcgaatgacgaaggtcgtcgggttggccggtccgcatcgagcgacgcaaaaagcggttcggtcgctgctcaccggttacttgctttatgcgcttggcggcgacaaagaatatcgcgacttcgccgacccagacatgcacctacctcatacggtcccggtggaccccgaggcgccattggtcacccccgaacagaagatcgtcacgctgctgaagtaacacggcccgacagcggtgagccactgtcctggtggtacgtgtcgttggtgtgcataggcattgcgctggatcattcgagcgggtttcaccaagccatcgaccgcatcaccgaactcgaaaagaccggcattgacgtcggggcggtggccgaagcgtattctttcgacgccgccaaccagctgggctacttgacagccaaaacaagcaccgcggaattggacggagtactcagcgtgtttcccatagacgccccccacgccagcgttgctggcaatgaccgtcgccggtttgaatttcgtatacggtggccaagtccgtctcgggctcagcacgtccagaccgcaggtgatggaagggtttcacggcgtcgagttcgatgcaccgcaccgggccgcaccccgcgatgtcgtggaaatctgtcggcagatgtgacgctgagaagcggctgcaatacgcccgtaaacattatcagatcccacttatccgtgaaccgcgtaacagggttaagcaaaccgctgcatctcatcaatcaccctgtgcacgagcgtgttcctgctgcgatcgtggaactgaggacgaaaaagttgagcttacttccgagatcgccaaggaccggaaaccgatctttttctactccgagaaggccgagtcagtctggggtgaggagctgacggccggcgctgccaagcgggatcccacactagggccaccagagatcctgctgcatgcgtcgttggcgataggcgacggcgatcaatgatcggctgaactggacaaaacgcaactggccctttacaccacatcgacgaaataggagccaagagccacaccttctgacgaaacgctacgggctcgacgcagtcgcggaccgaatacagaaactgagcggccgtaagcatgcggccattggcacggttccgtacgatttggtgcacggaatctcgctttcgtcccaagtcgattcatcgccgaacacttagcctccttcaacgaggctggtgtcaccacactagttggtgagacctatggcgacagacccaatcgaggtccgtgagctacgtcgagaaactcctgtagatacagtccacttgacccgtcactgccccgcctccggagcccgcccgcggcgatcttcacgtgtggagttgatccgtcggacagcggaagcgcctagccattttgacagcggcgcagcagctggccccaaagtggcagccggcggtggtgtatcaaccgatgacacccctggggctcgttgaccccggtgatggcacaccaaccggggggattcctaatcgggcgacagcgcttcgaacttgtccacctcggctgtttcttcccctttttcgaccctggcaccagggatgtcatcagcatcatcatcggtggcgtagtgtggtgtcctcgtcgaatggagactcgaccaaccgatcgtcaaacgccgacagatcagacagctgttaaaccgccaaacccagcagatcaccgatagattcgacgatacgactggccaatccgccaaggttgctcaggccaccgagagttacgaagcttgctggagtgtctgcacagtgggtacgcccgaagcctgaccgattgaggttttcacgccctaggtggtaggcgtcaactcagttcggcacagcaaccggcggtaaggccagaaaggcaatgggtcggccagcctgtcgtaaaacgctgctacaccagccagcgtcgaactcattacagtcagtcgttgcgaatatcgttgtccacgtagggctgtatcttttggtgaaccagctcgtcagccgtcgaccgatcccctgccccgatcgtaaccgcaccggccgtggccaaccctaccagcctgctatagtagcgatcgtcgacgacaatgaccgcagcgatcttcgaaccaagcaaatgccacaggttgtcgcgtagcgacccacaccgctgggcggccggtacttgcccatgcattcggtggccaccgtgtttctggagtcgcaacgggcctgtagaaaccgggccacggagtctgctctcgggccccatccacgccgctgccagctccgcaaccggggcacgctacatccgtagcgcacagctctgccacgctcacgatcgagcgttcgaaggtcgagaccgtcttcactgtcgcaccaatcgcggatctggaaggggcgcaacattagattgggctgtttgtagccaagcaactggcggggcccgcacgtacttttggcgaaccgaccctcagcaaggcgctcggcgacgtctaaccagcccagccactatcaggacgatccgcgacgcgacacataggtcaaccagcggcatagcggcccacgccagcccacaaagcgacgccgatctgcgacgaccgcacacgaccactgcgataactcagccgccagtcggtccagtgcagagcgcaatgcctcaccacgggctgcgtgcactcagccggcgctgaagccgaagccgccaaaagccaccccaagcaagtggtacggtgataacaccgtcgataaatgcggccgcaacgtcgatactggtatcagcaataggtctcataatcttaattcgacgcccgatatcgcgtcggggttccagcatcggagaggtgacccctgagcactcaccgctgcagcgactcgcgtcgccactcggtgcgcgacatcttcttcggctgcctccaccatgacccggatcatcggctcagttcctgagggacgcaacaggattcgacctgtattccccaattcgacctcagcagtctcgaccgccgtctgcactaaaggcgcagcggcagcagtggttttgtctgcaacctcgacattgattaacacctgcggcaacgcccgcatcgccgacgcgagggcagccagcgaagagctggtctgcaccatgcgggtcatcaatcgcaacccagtgatgataccgtctccggtggagcccaatgcgggcatcacgatatggccggattgctcgccgccgagactaaagtcaccagcgcgcaactcctccaagacataacggtcgccgacgtcggttgtacgcacgatgacgccgaccgaacgcatggccaggtgcagccccagattgctcatcacggtagtcaccaaagtgttggaagacagttcgccggcttcttgcatcgcaagcgcaagcacgaccatgatggcgtcgccgtcgacgagatcaccattagcatcaacggcaagacaccggtcggcgtctccgtcgtgcgccaggcctaggtcagcacggtgggcaagcaccgctgaacgcaacgaacccaggtccgtagatccacagcgatcgttgatgttgatgccgttgggatcggcgttgatcgcgatgacccgggcaccggctgcgcgatacgcgcgcggtgccgctgacgaggccgcgccatgtgcgcagtcgacgaccaccgtcaagccgtcgagccgtatggtgctggctttgcccacgtggcgcaagtaacgttccgtagcatcctcgcgccgatgacgcgaccgatcgccacgccggccgggcgcaacccgggcccgccggtaaccaggtcttcgatctggtcttcggtgtcgtcgtccaatttatgaccgcccggcccgaagatcttgatgccgttgtcgaccatcgggttgtgggacgccgaaatcatcaccccgaagtcggcgtcgtaggcaccggtcagatacgccaccgcaggtgtcgggagcactccaacccgcagtgcgtcaacacccgcactggtcaggccagcgatgacagcggcctcaagcatctcaccgctggcccgcggatcgcgaccgatcacggctacccgccgccccggttcgcccgagttggccaagcaccgtgccgccgccgcgcctagggccagcacgagctcaggggtcaactcacgattggccactccgcgaacaccatcagtgccgaatagtcgacccatgcggacaaacctctcgcaattaatgactctggcacctatacgtgcccatgtgtctttctagccgaaaccgtgcaagtttagccgtcgacacaccaatgatcgccgatcagcgcttgctgtactgcggcgccttgcgggccttcttcaagccatacttcttgcgctcagtcgagcgtggatcacgggtgaggaaaccggccttcttcaaggcgggccggtcctccggtgacgccaggatcaacgcccgggcgatgcccagacgaagcgccccggcctgacccgatggtccaccaccgtgtaggagagcgaatatgtcgaagttccttgtccgctcaacagtgaccaacggtgctttaatgagctgctgatgcaccttgttcgggaagtagtcctccaggctgcgaccattgagatcgaacttgccggtgccgagcaccaaccgcacccgcacgacggcctctttgcggcggccaacagtctggatggaccgctcgaacacaaaagattcactatgcttggctgctggagtccccaccgcaatctccacggcttcgctggtttcggtcactgcgctacctgcttgatttcgaatggaaccggttgctgagcggaatgtggatgatctggtccggcgtagacacgaagcttgcgctggatctggcggctaagcttgtttttgggcagcatgccaacgatggctttctctacgacgcggtcggggtgcttttgcatcagctcgccaatggtgcgtttgcgcaagccgccgggataccccgagtggcggtaaaccatcttatgctgtactttatcgccgctgatggcgaccttgtcggcgttgatcacgatgacaaagtcaccgccatcaacattaggagcgaacgtgggcttgtgcttgccgcgcaacagagtggccgctacagcggcaaggcggccaagcaccacgtccgtggcgtcgatgacgtaccacgaacacgtggtgtcacccgccttgggcgcgtatgtaggcacagcgcttacctccctctttcgtttcggtttctacccggttcctggatcccaggtataacccgggtgccggtcaagaagccctggctgattcaaggcggggttgttctcggcgaccgacattgacccgaggctcccggcgtaccagcacgccaacgaagaagcttaccgacgcgcatcccagcaggtcaaaatgactgtgtggtcccgacgactctccgttgtcgggaccccaacagatctgttgggcgtggctaccctgcccaaacgccacccgaccgacggtcggtgttggccacctcctccgcgccggctcgtatcacgttacccaagtcaaccaggatctcattgagcgcggtagccgcctggtgccacttgagctgttcaaccggatagacgaccaccgctgcacgaatccaacgctgctgcagcggcgcgatttgtgatctcagttcctcgagcgccgcattgaagcgggccggacgtgccgtcgatttcccagctaatggagtattcgatttcgtcggcgctgttaggacaacaccggatccacgagcgacctctcccaatcacaggttgcagtcggctgcggcaatgtggtgtgcatggtttccgggcagcctcgtgcagcgcggcctcgtcgtgccgaatggttttcggcgatggtgtagatgttggcaacaacctcggcattaaggaaatcttattgcagcgtggcaagttttggattaacctgctgcacaaacagattgaggacagaaagcagcgctcctaggtcatcgcatgaccacgcagaccttcagacagtgagctcggtgtcgcgttcagatcgacaagattgatcttccatagtaggtcgataagctactggatcaaagtattaactttcagctgcacagctgaggaccgcacgcacgcattcgaacgcagctgccgctccggaattttcttgggggaggggggaacaaatcaaccgatttcacaccgaagatggcgttgcccgcaatgtggaccttcatattggaagaaatgaaaccatctcaacgctgtcgatggacagcgttagcggggcttggtcgtagcgatagctgatgtcggtgaccttatcaatctaggattcagcgatacttaactttggcgcccttattcatcaccagtccagtcctcggcgacgacaccgtgacggtgtcagccgatgtgaaagccgccgtgtatgaaaagttaagtgagggcgaccaacgcgattaccaacccgtccagcagcgacactgtcagccggtcagttctgcgtcacgatccggcgtttgccattgtcctgtggaagtgtctcctaactcggagaggtcgaagttaccgaacgcaccgtacaccgccaacgagatcaccaaaataatgacaaccaccatgatcagcgaggtccgcaccgcctgaccgactacaatgcctaacgacccgctactagctttataaccgtatataggtatgcaccatcatcaccgcgatcgaaaccacgatggcctgcagaaacgaccacagcaagtcggagaggataagattttaaggtactaaatagtagtggtcatataagcctttggattgcccgtagatgtacaccgtggtgaagtgagccgcgaaggcaccgacagcgaatacagcaggctgatcgccacgaggacggcgatcagccgagtggcgatcaggtactacgtcgcgtgcatcgcaatacactccaccgcgtagatttcctcggacacccgtatcgcgcccaattgtgcagtgaaaccggaaccaatggtgactgccaacgggataccggcgatcaacggcgcgacaactcggacattcaagaacgccaacaagaaaagccggtcaacgcctagataccaacgctaaccaacgacgaggaaagttgcacagcgattacgtcaccagacgccagtgtaaggaatgtcgtacccccaaccgtgccgccgatcatcacaaccgcgcccgcgtccagcgtcattttggcaacgaatcatatcgtctccttgcggtatcggttgggcccgttcgggatatagcgcagtttggccgtagaagaaagcctgctcgcctaactcgtcaaccggatgctgcagcctggaaacgaagcagcgaaaccggattggtcaggtcgtaactcatccctcgctcacttcgccgagcgccggacaccgatcgacattaatgatgaacaggcggatgaatgcgtaaacaacagtttcattaaccgcattaccgacgcccttgggcccatccttgacgatcagaccacggtaacagccaaccaagacggccataactccgaacagaagcgcttttgattttggcgagaaccaactcacgcagtactatgagcacagtcaacccgttgatgaacgcacccaggttcgcgccctgaagcagggcggaaacataaccttctagcaagccgatgttgcacaccaactcgttgagcagcaacgcaaccagcgtaaaagctaaaacccgggcacgaggagccgttggatcgggtcgatccccagaatccacgtcgcatcgatttcctcacggatggtgcaagcgcccagatcagcccggatcgcggtggcaccggagtcagcaacgactaggcacagctaggtgatggtccctaatgccgttccgacgtcagacaaatcggcagccccaatctcacgtagcaaaatattgatagagtgaaaccctaccaggaccgtaaacggtatggagaccagcagcgtcggaatcagtgacacgcgaacgatcgtccgggtctgatctaaaaactcgcggaattgggaataccctaaggaaaatcacacaaagtgtatccaatgaaatttcgaaaaaccgccaacaactcgggcaagaaccacaagttgctgaatcaaaactgggccaccccgtctgctactcgtgtgcaaagttttgcgttaccactttgcacggaatttaaatacatatgcggcccgctcccattaacacaccatgtaaataatgtagcgtttcgccgttagttagtcagtacaagtcagcacccgggcaatgcggacaatctgatgctattttagtcgctaacgggaacgaaagaatagagccactccggtggtagtccttatccatccatcagatagaccgcggaaaatttccgttccagatcgcggccaataaaagtagtcctgcaatgggcactgagttgtatcaaggtcccaggccacagcgtccgcgctgaactgacattccacagtgggcagccgacgccagcgtcacccgaaaggctgtacacgatgaacacctgcccattgactgctgcttgtcgctagcaaggccaaaaaaggcaacaccgatgtcaccaaggaaagtatctaacagagtctggactgccactaaatcagacacatagggcaaccggaccggaaaacatcggacgtcatcacgttacgtactcgtggacagacagatcgcgttgacgcacaccccgtaccgggcccagtgcccacgtggctgacaggatgagcgcggtgctgcccggcccttggttagcctggcccacggggcctgccaaagccgccttcgacgagatattgatgatccccggccatatataatatggagccctatttggcttcttttttagcgctggtgcgccagtacattgccgcggtataggtgagcaggaaatggccacgcaggtacacaacaattaccacgtcccattcttcgccgggcatgttgaaaagcattcggccgtaagtggtaccgatatttttcaccacggaacacagtccgcccagcccataggcacaactgaccagcttgttggcggtgacacgtcgattaatgttgccggtcaccgcgacggctttgctacccagggcgctgatctggtcgatcactccggagacatctccagcgcagcgacgatgtcgtcgacgactacagtggcacctgacagagctaaaccgatcgcctcgactcggcccagtcccgcgaccgcaccggtcaccaccgcgacctttacggacaaaccgagtcgcgttcgtaatgcaacccggctaaaattcagaccgagtttgggtctgatggaaggaagccaaagcatttagccctagtcaacttatgaagatctctagtttcgagtaagtcttggcgcagcagcgccgcacgtaggcactcggcaattgcctgttcggccctaacttcctggtctgatgaaaccggatccgttctcactacggcataatcctcgtcatctaaatcaaacacatctgatgtgcgtcccaagcacaccgtattaccctcgcaccggtccacgattactcacacgacctccttcaaggctaacttcctgcttccgtcaagaaatcaatcagtatctaacaactcaccataaggacccagtaagcctgacaaagcggttgctggaattcacactagaacgtgttaatcagcaagacggatggataatcgtttaccgacgtacggtgcccagctttggctagtgatgtggatacgatcgcttaattcaaagaacggctggaatgcgcattagatataaccctgggcaagaggagttgtgtcacgaacgccggtagtgcttcaccgcatctcatgacgtcggaggtcgctaggcgccgagttcagtccagggaaaatacttccaccggcaaggtgtaccgggagatcgtcacgcagataggcaaagacgggtggctcaccctgaactgacgcagggagtacgggggccaagaccgctcgccgatggactcggtaatcttcaccgactaagcggtcatcgaggatgccccggttccgatcccggcgatcaacagcgtggcgtcgacgatcatgacctaaggaattgacgagcagaagaagtttttcctgcagcacattgctgacaggaatctacacttcatcaatcggctattcagagaccaataccggcaccgacctggtcaacctgtgcaccactatggtgcgcgacggcgacgactacgtaatcaacggccagaaaatgtgaaccagcttgatccagtacgccgacgatgtctggctagcggtgtgcaccaccccggaggcttctagagccaaaaaagcaccgcggcagctcggtgttgattgtgtcgtaccaccaccgaaagattctcatggaaaccggtgcacaccaaggccgatacagataccaatgccacctactactccgacctgcgggtgccggtgactaaccgggtcggcgcggagaacaatggatggagattggtaaccaaccagctcaaccatgagcgagtggcattggtgtctccagcaccgatcatgatgtacctgcgacaagttcgcacataggcgcagaataccaaggatgcaagcggaacgcggctcatgaactccgagttgttatagcttaatctgggtcaagtgcacacccaagtcgaagtgctaagactaagcaactgggactgagctagtcactgaagtttaccagttgctgatggagattctaggtatcaggctaccctgcgacagaactcaccaggtgtgttgttacacagtcatgacgagcggatgcaccgggcatgcctggccctaaccttcggtggcagcaccaacgaagtccaacgcgacatcattgggatgatctcactgggactactccgagccaaccacggaccttcgaacagaaagacattcaaatttaaccataaccaaagcggcggctgacctcgctggcttggttgacaccatcgtggacacggtatacacaccggaacatcaacgtgagccagacgggctcgaccaacgggtcgataaaaagctgtgccgcaaattcatcaattacgacatcctgtccgccattgtagcgaaatcctctggttggcagtggactcggagttctcgagcagacagccgtgttggttgtgcgagaccagcgactagccaccgtgccgtatatggagtcggtggtgcttggagccgcttcactagcccggttttagcttcgcggacctgcagcaggagtagggctcgaccggaggtcagcgacgcaaagattctcaccatcgccctcgatagtgagataggtgcggtgacagtgcattctgaccgctcctgcgacggctaccgcctcaccggtgtacccacacccaggtcggctacgctccgctggccggcgcgttcctggtttacgccaatgaccacagggctcggtgaccgcgctgcaaaccagcagcttgggctgcgtcgaacacttagagctagaaaatttagcgatcgacactgccagggtagttggcgagagtgaggctgtaatctggatcaccacccagtccaccttggtccttaacacgtttcaactcagcgtcctagcagcgaggcctgcagctgactgccgaattatatgcacgcccggcgagcatttcgaactgtctcggtcggcagcttccaggatgtggcgcacgtactagcctgcagctacatccatgtacaaggggttgcggctgacgcttacccaggctacgtggtgagtataggaggacccgcctacgctgacatcgaggttgctaatgaccccattctgggccattgaagctggacaccgggtggcacacaccatcgtgcacgtacacggcgacgtcggcatcgacaccgatcatcccgtgcactgttacttcctggctgccaaggagacggagtgagcgctaggcggtgccacccagcagctacgccagatcgaccgtgaactggcagaaacccctgcctagctcggcccgatgttttacatgtacccacggtcacagaactgatggtgccgctgaccaagatcgattaccggagtttctacttcgaggattcattcactagctggcgtgaccacgtccggcaagtgtgcggccgatcgcgatgacgctgcgtgaacgcctacgatccgcagcagccgccacatgtcggcgtgttgctgaaaaatacgccgttcttttctgcggtgctggcggcggcgtaagtgtaggggattgttccagtaggcctcagccctgtacgccgcggcgcggatctgaccagctacatatgccagaccgacctgccagctcgtgctgagtgaatagaaaccagctgcgatgttggatgatatcgaacatctgaacatcgatttcactgcatgggctacgaagtggccgcacatcagaatgacgcaccgagcttccgatcaacggctctttcagatcggtggatgctgatcttcacttcgaacaccggtggcaagccaaaggcggtgaaatgcagccacagcagggtcgcagttgccagagcggctatgatgtagcaccgcaatctgtgccgtgacagcgtctaataggcatctatgccgttgtttaactccaacgcggtgctggttggctgagcagcagctgcagcatgctagtactcaattgagttgcggagccagttctttgcgtcgaactttttggtggatatccttgagcaagccttggcgtatgtgcttgcaacactcgaacagcccgatgatgccgacaacccgctgcaggcagcgtattgcactgcaaagtataattagcaatatcgaatgcttcttccgccagttcggttgtaatgtccagagcaggttcgggtcgaccgaagctggagtggctacctcgcttgcctcgattacgctggctatgcgtacttcgctggaaaatttggcgattggatgcgtttcgacaatgaaaaccggcgccgcaccgatctagcgaacattgctgcgataccccgatgcaaaataaatgttggtgatggcaccgggcccgacgttcgataccgagcaattccgcaccttcctggccaaacagccggacctaggacctaagcaagtaaccagcgtatgtccgagtcgacgcctcgccacccaccgttaccttcaaggtgcttaaacggcaattgtcggccgacggcatttgactgtgctggttcggtgtggccgatttcaccggtcaaccgagtcgggggcgtcaccccacgattgatggcactaccgtgtcgatcaggtgcggtccgggttcagtgaaggccaggcgcagggcatcggccaacccctctgtggtattgacacgacgagcagaaactcccataccctccgcgatcttaacgaaatccattgtagggctagataaatcgagcagactcagcgctttggggccaggcgtcgacccggcacccatccgttgcaactcaatccgcagaatgttgtaagcaccgttgttgtagattattgtggttacgtcgaggttttcccgtgcttgagtccacaaccccgaaatcgtgtacatcgccgacccgtcggattccaggcacagcacagggcggtcgggggcggccaccgcggcacccaccgaggccgggatgccgtgaccgatcgccccgccggtcagagtcagccaatcatgggccggtgctccagcggtagccgcggctagcagcacccctgaggtattcgattcgtcgacgacaatcgcccgttcgggcagcagcgcgccaatcacgttagccgccgccccagaggtcagcggacctgacggcagctgcgggcgcgatgcggccaccaccggcgcagcggtcccggatgccacctcgtcagccaatgcgtttagcgcgtaagcggcaccgccgtgctcggcaagcacgtgcacctcacagccggctggtaccaagtcactaggcatgccagggtaggcaaagaacgacaccggcgactgggcaccggccagcactagatgcttggcaccgtccagctgagccgcggcgacctcggcaaagtaggcgagtcgttcgacagcagggacaccagcgccccgctccaatcgggccgggaacgtctcgcagaaccagcgggcgccggtcgccgcaccgatccgcgcgaccgctgccaaccccgaccagccggtggcgtctgcaccgatcaaaatcaccgtgggttctcccgattccagggccgtgcgaaccgcccccacgtcgacaccggcactggctggctggtctgacaccgacgcggcgggaatggcgccgtcagaccaggatacgtccgcgggcaggatcagcgtcgagatctgcgagcccaccaggctggcagagatcgcctccgctgcgtcgaccccaacgtcggcggtgtccattgtccggtgcagccatcctgaaacggttcctgccagagcgtcgatgtcggattccagtggggcatcatacttcttgtgataggtggcatggtcgccgacgaccaccaccatgggcacccgtgcgcggcgcgcttgtgcaggttagccaggccgttccctaatccgggacccaggtgcagcagcaccactgccggccggccagctatacgagcgtagccgtcggccgcaccagtggccacaccttcgaaaagggttagcacgccacgcattccggcaacggtgtccagtgcggccacgaagtgcatctccgaggtgccgggattggcgaagcacacatcgacaccaccgtcgaccagggtactgatcatggcctgagcaccgttcacctgttttcctccaatccaaaaacatgtcccgcgttgccgtgcaggaagtctcggcgagcctgatcactgcgcccgagtttgtccaaccccgctagagcatgcatgtgagtcatcattgggtaattggtaccgcacaagactttgctttgtccggtaatggttttcataaagcggatgagttttttgcggaagccgtttgattacataggccgaggcgtcgatgtagacgttctcgtacttacaggcgacagccaccatctcctcaatccacggatactcgacgtggccgcacacaatcaccaactccggaaagtctagggccatctggtcgatgtagagaatcgggaacacggtctccgacgcccccaccggcccagtttaaccaaccagggtacaaatcggcacagcggcttggagacattcggtaaatcagtatatgtagcggaggtcgatgggcggcgcattccacaaccaaagcagcacccgcagtcctacaagcccgccaccacgcactcgccgccgcaactcgcggaccaattccatcgggccaaccttggccaggccaaaaaaccggttcgagtacaatcggcaacgatcaatcattgcagatcagatcttagccgcccggccgcgccacgcactcagcagaccgaggtcgacgtcggtgacgtacatggacaagatggtcgcctcgatcacgacgtcggtggctggaattctcccaggccagcaccggcagtgaggctagcatgtcgctgcgcaggaatcgcgcagtaggtgccacatacacacgtcgatcgtcatagagcttcaactctagacacgtttatccggccagcgtggcgcgagcggcggcatgtgtctgccctgcgtaccagccaccgaacaacacgacatgcgctagcagcggaaagagtcgatgcaaccagatacggttgtgctaggaggctttcagcgcttgaaccagctaatagctggcgaagactgcatcgtaatgcaagaccaaacaaagcgagcatcactaagtcgatctcacggtgaccagcgtgcacagccggctagatcagcactactcgtgcagtgcccacatcacattgccgctccacaaatcgccgtgtaaaaccagaacagataaccatagtcgtcgaagtcacctgcccagcaacgtactacgacggagtcaatgatggcacggatcgtaacctccaggcatggcgcaacaagctgggccatcagggccatccgttcgtaagcacagaaattgccccaccgcgagtgactgccgcaacgacatcggcaatggctgtaacagcggtcctaagaaaccgggcccgttccatacgtcggatccagtgccaacacaccgcggcacccacatcgtgttgtgacagccaatcggctactgaacgcgtatgccactttcggggctcggagtcaccgaatcaagcctcagccgggtcggactggcggcgtcgatagatactacctaaacacaaaatataccgccgtcaacactggaaagccaacacagcaaaccagattcccaggcgaagaagccggtgggcagcccgactagtgcttgacgaacacagtcacgctgctacatgcacaccatgctccggtggtcacctggcctgaatgcacatcatcggcagggtgctactcagtctgttacatggcccagcagtaatagagtttaccgttcggtaaatattttacctcacctaccaaccaaaaactctgaggcgctttgtgtccctctatctcagagcgtagaaaactgtccagttcggccagcaccaaccacggccccgtccggacctgcacggacagtagacacatgctggcctttaccgaggatcgattacaccaaccaccaatgcgtcgcagaagttggggtggctcttgaaccccgcttaaaactcttcggggtagatcttctcgccactgctattgatcgacaccaaaccacggcacagcatggtgaccgaccccgtcagcctcgaccactgcctcagttgcccataatgaattagcttaacaccactgatagtcttaaacatctcgacggtcttctactcgtctttgcaatagccaacagggatgttgcccttcttggcaatgaagtccgcgcacgcccgagccaggcttgacctcgataccgtcctcgtcgaggaccacggtctcgatgtttggggtgtccggcagcactttggtggccgggccgtatgtactagcgctcgtgcaccagcgcaaccatgtctaaagttgttgaagagatatcgaagtttaccctcgacgtagcggactttaacgttgactagaatgttcccccttcacgatgccgaacatcgctatgacaatctcgatgctgctgcgacagtagaggactacttttttgtcgtccttattcacaccctgacctataaggtagtgtccgaagcggttggccttctcttctagttgggtataggtcagctgctcgtcgccacagatgagggcagcacagtaaggcatagtgtcgatggcgtgcgcgtcgaggatcgacaggctgccatgaatccatgaactagaacttattacatttattggaaagcgagagacggtagccgtggccgaggctccagcaaacgatttcgtacaggacgcgctggtgtaactgcacagatacacccctcattgtgacaatgaacagaccggccgcgcacaaagtgctgaacagcaaaataataaaaattatggtcgagttatgggaccgcgtcgacaactatcccgacgtccggtgccaaatcctgaccggtgccggcgtctgactaaaccaaaccgctgattgccgatgtcgaagatacagccatcaccggtgataccgagatcctgcaaggaaccaatatccggatcgccggaaaaagcgccaagttcatcatctccgaagccaaatggagcctctatttcatggacagcccgaccgtacgtttggtctgacagatcccctacaccgtgtcttgttacctgcagctaactggacagcgcatcgccgccaccgagggccaaggacatagcgctgatccgctatgtcctccccgaggggcaagcactatccaaggctctcaaaatcgcggagataatctcgaataacgggtcgcggctgtgcaggcgattctatagtcgatccgcaagaccaaagggaatgaccgaaagccaggaactcaagcggaaaccaggcattcaaaattgacacccaaatcgatatcgaggtgttcctgtccaaaaacgctaagtaaaacgcgaaggcgttcactgagaaccacaaggccacattccaaaactgctaaaccctattcaccaaacgtgaactctactctggtctcacagcagaggcctatctcaccccggggtccggggcttccccgaagtaggcgctcacgagacatcgatctgagcaactcagcttcgatcaattcgtcactatcattgcataataactggttccaggctatggcttcatctctttactggtcaaaacgcacaggccgacgtttaagtcggacacagcagctaagatagcgcgatggaacgtcgacgttaagacaccaacgaccggtcccctatcactagcatcgcttctggtcaagcactcgctctctgccattgagcggctacgagtgcattgtaaccacgatggccgaatcaccgaagatcccgaaatccacctgcgtacgctatcttcgacgctattgccaccaaccggcatagccctttcgactgcttgatgcccggctaaacaacgattacgtctataaagtcgataccgaggtcacaggagtgacacaaaccgacaacctgccgatccggccaatgcttacagtgatcgcccaaacaaccctaactgttcgagaactcaacgaacacgctatcgcgcgcatcattaggcatgctcgatgatgacagcccctatgcccgcacacagacatctcattcggctccgcatacgctcctctgatgcattacaagttggttggccgcgacgtcgttgctgacccactctagggtgaaccgaaagccttccggaccaacccggtgtcggcgatgagcagcggtggcaacatccacgtcagcacggcatactccgtgctgagctagcccaatggcacggcgccgacggaagcgtggcatcagtaacggcgacgaaacgatatcgtgacaaggtattcattgaatacaccatagagtgtcttcccggcctgcaaggtggtggtagacacacaagtcaacatccgcgacaacgaaattgtacctacgccagcattgagggacaatgcgttttgcggaacactacctataccggatgccctgcaatgtgccgatgatcatgccgtcactttggatcaagaccggttgcatcgaagcgtaccccccccccgacattagcgccttgctgttgagtaactcctatcaccccgacagtgctacgctgacgcgcaggctggccgatcagcttggattgcgagccggctagctgttagcctgtatctcctccggtcttagagcaacgaactggctactcacaagcgaatacgatgtcattgtcgacggcgtcgatctcggcaaagtcaacgtcaacaacgcacaagccgccgctgcggccaggtaggatgtgcgagtgtgcttcaatcacggcgattgccaaagaatttctattgccaggcaacagagtcgacgcactagtgtgcgaatacgcgccgtgtaccttccccgaacgaagaacgtcacctcacggaaattcgcccggatccgtcgtcctgacggcccagcaggcatcaccataacagaggacagcctaccggtcgagctgacctcacttaccgactgtgttgcttgcattggtttacgcccggaacggtcaccaactacaccagcattctcacccaagcaggacttcagttgcggcacaaagatccccgggacgggttcctgctagagatgatctaccgtgtctatcacacggataatcgttgcgcgacgtagcaccaaagatccttgccgacaacagcgtggcacggcggagctgtatcgacatacagcagctaatgactgaagtggtcaaaggcggacacattagacataccctcatcatcgcggaggaaacataacactcaaagacacattctcgataagaaacaagacaaatagcccggattctggccgggattgctaatcgatactgcggacaccagtaccctcaatgttatcgcctatctggaaactgttggccaacaaccgattacgcaagtaaccgtcccgggctagggctccccactaactagagttcgcgacgtcgccagcaccgtttatcgatagcatcacgctcaccggatacatcgtcaacatcggtataagactaaattatcttgctagcatacagtctagtctagcgatctgggctactcgtcgccacattgaccaccatactcttcgcgctaatcggtaccatcgggccgatgagtttgcccggggtgaccgatccgctagcttggaacctcgtcggttggatcagcaatctcatcccgaatttcgtgtacggaagtgctcaatgctcttgcgttgcactcccccacccatcatcgtggtaatgactccgaaagtccttgacttgtaatgaattatatataattcagcatgcaacgctcagccaactactgcagatgagcgacgttcatagcaaggtcagctcaagccgctgaaaacacgagcgataacgcgggggatcgcatgtcgcacggtaaggctagtcactgcgatgcgggcaccaatgtacaaatccggcagcaacaaacgcttctggcctctgagtcactggtaatcgatgaaacattttccggccaaaaaggaaggaggcttcccattacaaagcttcacactcaaattcctcggcaatgcatgctccgggctctgaatcagctcaaaatcgcattgatactctcaagcatatgatcggattggtaattttgccccacagtcaaagtcatcggccagctctgtctcagagcagtcgcaccaccaggggtcgtcggtgaaaaggtccagcagcaaatctgaatcgacgagtctacctgccaccgtcaagctattcatcgtagtgagtaagcgtcatgatgatttcgtcaatacccccttgtgcctggtaccgccgcgtatctggcgtgtatatagtcttgcctcgtgcagttttcgcacacacaccggccacaaccctcgatcgccgagttcaaattcgacttcggaacccaactcgaccccaaacgtgtgccgcacctacagcggaatcgttacctgccctttgattgtcacccatatagaagctaggcctacgacatgctaataacagtagagtaatactggacgcccaaccgcgtcaaccgatacatggcagaccgacataccagcggcggtggagagccgttgcttatctgctcacctcgactattttcgaacgagcgctgcggcacgactggcatgccagatctaaggcacgatggattcggtgacgtgaaacgtcgcgcttggcctgggtcggactggactttccagttggatggaagccgtagcgtcgggggttggaggtgatgatggtgcgaagcgccacgtggaagtgttcgtggcgggatgcccggtgtgcgaaccgaccgctagcctggtgcgggaacaggaaaactagcccgcccggactgcgaagtaatcatacacaatctgtgagagaatggtaccgacgcggcgacccggtccgggacagcatcagtgactacggtagtcgtgagcagcacattcaccgcatgctgccagggccgtacgccggaccggcagacactagcagcccagcatcggacagcgactctagcaaggaccccggggcggcctacccaactgagacagaccgcaacctcactgtgagccagtttgttgcataggaaaagaagtgtgctcgataattcgcgttagcaactggtttcagcggtggaccgctgcggggttagtgattgcgcggtgaccagttgttcacgcggccggctcatttcgacaaccgttggtcgatctcggcgaacttgtgatcgaggaccacgtacccgcaagaagagttagcac

SEQ ID NO: 131 - DNA (genomic), 42325 bp, MYCOBACTERIUM LEPRAE; double-stranded, circular
  hypothetical: NO
  anti-sense: NO
gcgaacactggcgtcgatgtcggggcgttcgtcccccgagggcgagaaactgccctatctccccatcaaccgtgaagacccggttcagcgcctgcagaccatgcacagccggttgacggccgcacagaacagagcgatccatcacctcccaattgcattgcgcgcccatgcgatccaactgttgaaccggctacagaagcctggcatcgcaacgctgacaatcaacgcgcccgggccccgccgatcggttacgactgatgggccagtggatggagcgcgtacggacgatcccgcccgaccgcactaaagctgaacactagggtcgcgatgttacgctacggcgacgaactggtattcggcatcactaccgactacgacatcgcacccgatagccaagcaacttaccagcggtattgagctgaagatcgcgtagctggcaccactcagccacgactccgtcctgctgttcaccaaaaaccgctatgcatgatcatccggcgtgttccccaccgaagcgcaccagttcagacgagcctccacgccttatgcacgagcgcgtcgctaaccggacatggagctccctgctgaccacagtttccaccgtgagatggttagttaatgccggtcaccatagacccgcggcgccacagcgcagcactgttcgacctcgacgccgtagtgaccgacaccccactcgactccacagtgacgctggtccggcaacttcaggggatcggtgtgggtaccgccgttttttcgaccaaccgcaacagccagggcgtgctgactgcaaccggcctcgaccatctgttccccgtccacgttgacggcctagctagcggaaaagtcaccatcctagtcgccgcggccaaccgcttaatggcgcaaccaggccggtgcgtcgtcgtcgcagtcgacgcggccggcataacggccgcacgctatggcggtttcgcgctggtgctcggcctagtaataggggaagatcagacaggccaccgcgacacactgcgtaactccggcgccgacacggtagttgccgacctaggtgaggtcatcgtccgaaccggggaccgccggatgtcggaacttcccgacgcgctgcagaccctcggcttaactgacgacctcaccgctcggcagccggcggtgttcttcgacttcgacggcacactgtcagacatcgtcgatgatcccgactcggccagacccgttcccggcgcgaccgaagcattgcagaagttggccacacattgtccagtggccatactgtctggtcgcgatctcgcagatgtaatcaagcgcatcggcgtgcccggaatctggtattccggcagtcatggttttgagtcaactgcacccgacggcacacatcatcaaaacgacgcagcggaagcgacgatacccatactggagcaagcggcgacccagctacgcgaccaactcggaccaattccgggagtcatggtggaacacaagcgttttggcgtagcagtgcactaccgtaacgtcgcgcgtgaccgcgtcaacgaggtcgcagtggcggtgcgcacagcaggccagcgcaacgcacttcgggtgacaacaggtcgcgaggtcatcgagctgcgtcccgacatcgactgggacaagggaaaaacactccattgggtgatcgatcgcctgcaccatgccggcactcaagtaggctcagcttcgctcatgccgatctgtctcggcgacgacataaccgacgaggacgcgttcgacgcagtgcgccacaccgacgttgggggtattccgatcgtggtacgacacactgaagacggtaaccgcgcaacagccgcattgttcacgttggacagtcctatgcacgtcagtgaattcaccgaacggttggcacgccagcttagtgacactcaacgctaggccggcaggtactccaaccgccccgtctttcagcaccacccgcatttcgtcgccgccaaagccaacgacctcagtacgaaacaccgtccgccctggctcggttctccaaatcaaggtggtcagcgtctcgccgggaaacaccggtgaggtaaatcgagctgatattaggcgccaaacctttacccaactcgacgaccaacgctcggcccggtacaccgtaacgggacaatacgtacaggatcggcttgagaaacccggctaatcctctcaggcaaaccacggatcactataaacaacggattacggtcatcagataaggaggtaaatcaacgcctaatcttcacaagtggacagcacgattcgagcgtcgcactcacgatccagaaaatccggtgccgccggccgttgccccaacactcccccaaaccctagatgaccagcgtggtccgcgtattagcgattcagcatcccagattccgggcccgtatcgcggccacacaacacaacgatcgggttcctgctcctcgcccttgtccctgcagctcaacgacctacggtgatccaccgacagccttccggcgccggcaacggcgtatgtaaccggatggcctgtgatctgtgtaagacgcaaggctcatttgttaaactttccgatctttgtcgccaccccgaacgccagacaacaaatcacaacattaggtggaaaatacctgctgaggtgatgtcgtgactgttatctgtgatgaaggacagattctcgattccaacatcgacgccgagagcatacagttatggtattttggttcgtcagttcggtcagcattggctccgtcaccacgccgatggcagcaggtcttttgctatacgagtctcccttaaagggaaatattcaagcctccatcttttctgcatctaaccatcgcaaaacacattgacacggtcagtccaaagcagactattgccacactcaaccgcaccatgatctggaaaacatgccgaccgtgctggacacaacggtaatcgtcgaagcctgcggcggaacaacacatgcacgcagcatcatgtttacctttatccgaaacgcctaatcctatggataacgcaaacagggtcatcgccaccggacatacccagtcccagccttaccccggatagcaaagaacaagcccagaaaaccgccgcaccgttggccagctagctcggtaagccggtcgagatcctaagtagcctacagtttatcgacgccggctggtacaacgacaaaacccaagacaataaccaaactcaacgtatttactggtgccggcagattggatattaacagtgatgtccagaacggcattccgggatcgacctaacggcaagaatttcaattctgcgttccgtgccgccacttggagaatctacaaacagcggccaccacaagcaagtgtgtttctcctcatagggtcatagggtgcggcgatcatggtctggacgctgatgaacgtgaagaacggtaaagacaagctgttgatcagccatcccttaccgaacatcggccgggtgatgatcaccaggagcccaattaacagttggaagctggtggactggcacagcatccgaaacgtaacctgatctccgctatcgaaaagacgtgaaaagctataataaaagcactcgaatctacgtaacctggttcatcatgtacgcacgaaacattttagagtcctaagtgcaactcaatttggcaagtggttttgagatgcatgctcaaagcttggagcacgaagcccacaagatgtgggcttcgtgctcataacatagcaaatgtgacttggaggcagacgaccactcaggccatttcgtacaacccgatcaacagacgaatcaaacatttcacaaacatcacgaaactgcttacacgaggtgtgtgacgggatggtcttatgcacgtatcaaaaaagctaacactatgaccaactagcacctcgataattgttcaaccaacctcactcacgctcaaaccgcttcgttgaaggccggacctccagtcccactgccgccggcaacggaagccgtgagaacttcctcagcaggctgagtcaccccttccagcggcccgcttactgccgtggtaatcgcgctgcagcctgccggcactgagtgcgccgtcgccatgaccggctgactggccgtggcccaattttccggcacccgcaaagcaccaaccgacacagcctgacctacgccggcaaccactttactggccgccacatccacgctcaccgcggtgctgctaatcgactgtatcattttctccacagccacttgacttcgacccagtgtttctgtaacctgagaagccactataggcataatactacttgccgtcgagctgcttatgctgttcgttgtaagcagacttgcactagcactcgatatgatactgtccaggcctcccaactgctgtgtaaggctcgtagcagaaaggtcgttgctctgagagctctgagaaggggtgccaaacggcgaatcgcacaattcagactgagcgaccgatccacacgtattgtacgattgggacatactgtccgatccgtgttcttcggactgagccaccgagtcatacagattatcgattgattcgtaaagtgaatcggacgaagacgaagaatgaaacgaattaacggaatcccgccgatccatgcaatatctagagaccaactgcggtgctggttcaaaattttccatttttcccgtttctctgagcacggtatcccgataggtcgtcattgccgtcgagttttggacccacatcagatcgtagtcggcttccaaagccgcgaccgtggtagatacttgcccgaaccagtttattgccttcagcgccatggtgtgtatgatgttcccgagcaccgtcagcagtggcaccatgcccgcacgcgcctcctcgaaggcgtatgccactgcgtggaggacgcgagcaatcagcccggcattctcggcgttaccatccagccacgccacaaaagtgctgacacggctggctaacatatccgacgtctcgcccgcaaatgacgccggcaccgcgacgactattgtgtccgacacttcctgcgccgcctccattaactgctctgccagactaatccatgcctcagcggcgccccatagaggagtagaacccgggccacgactcataagaaaagcattgacctcgggcgaatacaccatgaagtcgaacatgattttgttacctctatatcttctctataatcttcctactcgccggtagccactccgataccgccagaaacttcacacaatacgatgccccacagtgaggcttaacactccaacacttaggaggcttaatcctctgtgtttagatacatatgatcactgtccatataatcacctgcggcatctttcagactctggacaaacaaccgactctggtctacaccctgagcggcatacccctcgtactgcttcccgtaggaactaaatacctgcgatactagcttcgacacttggtcggcggccggtgggacaaccttggtggttacaggagtaagcttggcattgcatgccatagactcggaggtaatgcgctccaatctgccggctgccatcatcaacccacctacttctactctcagaaaaaaggacataactataaaaccctcctcgaaaattaaataaatccaaacaactgaaaggacaaaactcaggtagtctaagtcacctaagctttctggcctatgactttagtggtgctaagtgcactaaatgactaacctttcaacaccatccgcatcatagatccattggaataaaggggtctctctaatacacggaatgtatcatagacttgccggtcagccagaatcaactgaactatcccagcttcgctggtgactcttatcacccggagaagattgaggtgtggtagcgcagcggaagcactcggaggagctgagagagtaagcgacgcggatgacgcgtagacagctcgccgtgctccacggcaccgcaagggggcccgatcaagccaatcgccgaacagtccggtgtgcatcctgagacgttgcggacatgggtcaaggcgtgccgagacgagattgtttttttatagtgacgcgcaccctagcacgacatctaatgatgtcagccggatcgcagaactcgagcgcgaagtccgagaactcaagtgtgcccaatgaaatctatgaaccgcgagtgcttttcgcaacggcgaaagtcgaccgccaactacggtgatcgtcgaatacattgatacctaccgcgacaagttcggggttgacccgatttacccagcactgcccgagcggaccgccttgtccacctaactagtatgccgtcatgcagcagagactggtatcggcagctgatgttgacgacccctaatggtgatgggcgagcaccatgttcgacctgtgtgtagccaaccggcgcgtctacggcgtgcgcaagctcaggaacaccgccaaacgcgcaggccacgactggaggcatgatcatgatatcggggtagcgcgggtgatgtgtctggccggcctcgacggtatcgtgcgcgataagcgcatcacccgcacgaccgaacatgacaaacaggcgccaccgggacaccgagtacctgatcaaccgggcctagtcaacgccaaggtgcctggatcagtagttgagtcgccgatttcacgtatgtttagacgctgtatgaggtgtggctacacagcgttctgcgtggatgtgttctcccgccgcatcccggggtggccaggaagaaccagcaagaccacggtgttggtgacatcgctgtttgagcaagcgctattcatccggaagtactacgagttacgtttctttgcaatggattttagtgcgccactcggatgtaggtgatcagtacacggcgatcgcattcacccattcactgaagtactgcgctaggccgggatcgtcgactctatcggcaatgtcggcgacgcattcgataacgcatagatggaatctgctgtaggattgtataaatcgcatctcgtcggtgagaaagccaccttcactggccgagccgaattggaacgtgagaccgccaaacgggtacactggcacaacacgcccagcctcgcatttaccgaatcgaggacggacctccggtggagtacaagcaacgctatgatcaaatggtcacctcgaccgaggtggtctagattatttagccgtctccagcagaaccaggttagttcacggaatgaatgccagcagacccgcgtgggctgcttcgcggttatcagcaacccgggccaacttgtcgatcaatacatcgatgacccgatcatattgcacggcagcggattccacatcgggttgatcaaacaccgagtagtgtagcagggtacgcacccacggtcaggaagccgtgggtgcgcaggccatgaggttggtggcctaaatagatgcgacagcgttgccagaacacgccgggcggctggccctgattgtggcgagcagtccggcgtgggcatcgctggtgaccgaggtagccacgccggaaagccagcgggcggtcagcgaccgcagaaacttcaaccaaccgaccccgtcttcggcggtggtcgcatccacaaccaagagtttcgcggtagccctcggcgttgacatcagtggtgatcagagcatgcacattgaccacacgggaccggcctcacgaacctcgaaaccagcacatcagtcaagccatgagtgtaggggccagcatcgagcggacaggtacgaaaggcatccacaacggtgtcgagttccttagccatcacgctgacttgagacttcgacaggcccactggtcccgaaggtttcgacgaatttacccatccgccggggtggacacacccagcagacaaacaggtccaatgccttctcggcacgtttgcggagctccaagagccaatccgggaagtagaattaggaatcctgccgcaacttggagatcgctacatccagcgtgcttgcacgaatatcgaattgacggtgtccgaccgacagccactgcagctgattggcacgcgtagcactgcactgatcataggccgtcccggcacgctgcgtcgggttcaacgcccatcggcgcgtaaatgaacttagtcagcagttcgcacagcacatcagggtgggtgacagtgagtcgttcagccagtaactgaggccaagtgaatatcgtaggaattgatcatcgcgttaattcctttgctcaagttactttgctaggtctctcgatgaatcacgcgattacactcaatccatccgactacgacatgccggtcctcaactcacagcctgacttaatacacccacccttgctggacacactcccccaatctgcaatgtcctaactcaggcaccgatttatgatttatccagtaggctgaccggatcgagttagagaagcccgtcccgacagcatgaaacccaggaccacaactctgcacaacgcaggacggaccagagtctccgaactcaccggactggatcaggttcaccattgatcattctctgtatcttgtgcaggacaatagtcactgtaacgagttgcgaatacttcagcttctgcctctgcggcttgttccggcgacggcaaattccaggtattgcccacggattcacgtaacagtgcgacgcggtgctcatctccatcggccagttgactcagtttgtctaggatgaaagtgtactgggccgactgcgccttctgccgcgccaagtcagcaagaaccaggatctcggaggcgacctgtgattcactcatccatgtcaccctcttcgaaagctcaacatggtcgatccggccgtccatcagcaccgataccgacacggtacgtggggggttcgtcaccgtgaaaattgcgacctctggctccttttgtttttcatcctcctcagcctgaccgcgggtgttgtctacgtcggttccgcggtcctggggcgccgacgacgacgcaaagccaacaatcggatctatagtccagtgcgccgcaccgccgacgccccagggatccacggtgtcgcaatcatcgcggtcgaagtcgtttccggggaacaccaccacgacatccctcctgaattcctgccacgcaggaaaagtcgacatgggaagtagacgtcggttaatccgacgtctacttcccatgcaacgaacttggtcagccaaacgccgacttgatatctgatccacatatttcgtcagcgtcacaatacatggccgccgcaactcgcagaaccctagcgagatcaataccgcccgtatgcaaggactcgccaagagttcggtgggcgtcctcatacatttttaacgtgtcattgaactgggcgcagtacgaaccatgactggtcgagactgcgttggcgagtccggcggcagcactgacgccggaggaggcacaagccgcctcgttttcatgttgcgaggccaaggaattcaggtgttcgctctgaaccgtcaagttatctatcattgatcgcatcccttccgtctcttgctacagcgccggttcacaatggatctagctcgccatatattgttaaacgacgtgttgtgccaacgcccgtttaccaccgcctgattgaacttcgattggcgcacgctccgcatcgtctgtgcccgctgctgcgccttccgagtacttcttcttcttccgctcatcttttttcgacttcgtcgaagcgggagtcatgccgcccataccttgagagccgcccataccttgagagccctgtgcggagaccggctcctgctgtccgccaaactgctccgtagagagttcggccgaaacaccggcttgggaacgtgttccctgccgagtcgaggcggcatgcagctgagccagttgcggcaagctccctaagccgagcccggccccaactccggccaggctgggtaagttttctgtgctcaataagctctcgccgcttagtaacccggacgaaccggccaaaccgggaacaccaaacaaaccggtcacctgggacaagccgctagtcgcaccactcaggccagggatgcctccaaagaaggagtgcagtctcgaccaccagtgcgagaacagtccaaaaaaccaatggatgatcttttccacaatatccttcaggcccgttaacgcgcccgctataaaatgccataggtgatccacaatgccctttatgatcgctactccgtccgaaactacgtccgcgacagcggacgccaacaggtgcgccaaccgagccagcaaagcaacgaatttagccgtatggatcgcagtctggacgagtaggtaagcaagcccgccgctcactgcggccatggcagctgcgcaggcctgagcctgtatggaagccgacatgacagatccgacaagcgggatgtagttcaggtctatagccaccggacgcacgaacaggagcgccttcttcgcgccatccaggatgccgcgtgtcgtctggaccgagttggcctggttatggattagctcgataagctctttatccagctcagccagctcctgaaaaatgtccacccgtttacggttttggccggcgtatttatccgcggcagagcctagccagccgtcaccaggaaacgccgccgccaggtgctcaagcgctttttcgaagaacgataatgaagagtagagcactcccccgtcattgggtactcctatccccaggagtgcatgccaagcttcaatggcctttaacgtcggatcgatgatgaatgcgccgctcatgcctgccgcctacatcctaacagtcgtcgctatagaatataatgccgtaccatgacttatattgacctgttattgcatattgtacgattaccttcagaccgccacgctaaaaaaataattagatggatgagcataatgtaaaataaatattctagatatctttaaatatattaaattatatcgttaatacactataaatgaatataaaatcatttaattcataagattattaagtcataatttttcgaaattcactcaaagataacacaaaaattcattacaaaatcctttaacaatgtttagattctcgtcaacacttaaaaattttttcgttatagtgatctttaggcaaaatcttccaaatacaatatatacatatttaaatttcaatgctctgatttccaggcatgattaaacttttgatgttaccgcatactagactactagacagcgcatcgtacaaaatcgactcgacatggaataaccgtaatcgtatactgcctgcagatctgcttcgatcataattaaaacagttttccccttccaagcgttaaatcttgttccaagcgttgaatcttgcgcatcagcgaaacaatgcctgaacgtgacgcctgtcgtccaatagacgttcgctaccggctcataaaataaatttatcaaactagtgctttctggcttcaactcacactccaattgtattggaacaatgaaacgataccaccagtcaagacccaagtagaatctacactcgataattatttgtgcgggttgtaggctgagcgatcatcaggaagtcacatgcccgcatgttccctcatgtttagtcctcgttcgactactgttcttttattctttaggatgagacccgatgctggcgtccagcaacatgatcccgtcgacaagaaacacacggtgcgccacagtgaaaaatgcgtcgcagtgctcatacccaaaagggccgaaggcgccgatgctaacgatccaatcgacgtactcatcgaactgctcccagccttgcaacagaattcacttggaattgaaaagggaattttcatactgtgcgataaataatccaacatgattggcgtggctgtgactcaacgtgaagcccacgacattgacatcgtaggcttgcatcgcgcggaccttatttaggagcatcccaaccgcaaacaacgtcaagcagcgtcatgcacggtggtaatccgagtttgccgaatgcgagatagattttggctatccaggcctcttccagcgtaatgtcgtcacgttaaaaatatgcacaactatacgtctagttcgtgtcaaaaaatccggaagaaatcatcagccaagtgcgccttcatatagtcgaaatttcaagttaagtcgccttgttgaggatttgggcattttgtacaccgtaacaacctaatcaccagttccagtatcgttaccacgatgcaccctagttttcatcgacgtcgattaccgacatcgattaggctgtggctctggtatatctactggccaaccctgacatcaatctcgtcggaatagtatctcccggcgaaaatattgaagtcgagcagatgtgcgcgaacaaccttggcttggtcaaattgttccgggccacagccatacccgtgtgcaaaggcaacgacaagccactgtgcgaccaagtagcctgagaatgcaaaattccacagcccaaatattgaaactatgccgagattgaaactatgccgagctgccctccactgactgccggattgccagttacgatgccacgacgacttggatagatgccgctcgcacccacgctgagaaccgaatcggcctcgtcaccgggacgccgaccaacttggctgtgttattgtacaccgagtcggcacgcccgacgctcctaagccggctagtgatcataggcggcgtgttcgacggctctggccagagcaaagtcgcggccgaatggaacaatcaggtagggtgaacccagaggaggcaaacaaggtatttgcggcttggactgagcaacaacaactttcgatcgtatgcaggttggatctgacgctgaacatcctcaccaagctggtgtctaccgcagttctgtctccgttgatccaggtgatcaaggatgcgctgcgcttaatacattcgagtctcacgaggctcgcaacctagggtgcgtagcgtatatgcatgatgcgctggctgctgtagtcacactggatccggacttggtgacaacccaggccacgacagtggaggtcgagctaacatatccgcttgacttgacggtcgccgactggtcctcggattgaaagcccaactaccttgatctccattggcgtagcccctgcggcgtttttctaccgggtaaattggccgggttgggtcgttcgcaggtcagataccccaagcgtaacgccactgtagaacgcggagcacccgcaattgttcaccgccgatgcggccagcccggccgggctctgctcaccaacggcacaatgcacgcaagctgccgacagcccagatccatccaatggggccagaatatagtagatttaggtgcttaacttgaacgaacacctattgcgtcataatcatacgtcacatcgtgctgtttcttgatcctacagtagtagcggcatcaggcctaagcagcttcggcccctgctatcttcgcttggccatctgcggccacctagccatgccacgatgtgaaattcatgctggcacacggtatcgacaactctacccagtgttgggccaatcagagaagcattcatcgacccccctgcgccagcacatcggcggcagatcagtgggcgtatatccagttcaattaccccgacactaatcactaatgattggtacacaggcattaacgacattagggacgcaagcggtcacgtcgtttagatagcgagtaactgaccgcagaccaggatggcactttacgattattcccaaggcgcagctgtagatgggcttcgttacctcgactgcggtgctggacaggatagatccggcgaccgtgtccaaaccgctgcagcctgagtgcgctgaccacatcgctgcggtcgttctctttggaatgacaaatttccaagccatgaacttcctcggcgagtcaccggtcgccatcggcccggcccatcaagccaaggccatcaaggtaggcgtcccgaagacccggtgtgctctgacgaactcaatttcactgcccacaacagttacacagacgacgtcagcatggccaaccagagagcaacttttgcggccaatcgccttgtcgtaggtctcggcgggccgagtatccatggtgcggtctccgagcggagaccctagagcgcgagatgttcggtagataggacacgacgtcaccatagaatccacctgatgcaagctcattccgattcagtaacaaacgacggtgagaagttttggatccagtgggcccaggctgatccgcgagcatgaacggcgtagttgaagacgagttcgcggcgcgaacgttccagctcgtagagatgtgcgctatagccggttcggcaatggaccatgctacacacattgcttctggccgatatcgaattggccaaggctgttatcgctgagcgcaaacacatcgccgcgacgaactcaaccaccgaagaaaccacattcttgttgctcgccagggctaccagccggtagccgcgaatctacgcgaaatcgtcaatgtctacccggagggtgcggatacagaacacatgaccgacctggcggcgcgggtcactaataccgcccggccccatcaccctcaccatgcgatacctgcacaggttcgcggacacgtggccgaaatgggtgcactggcgggccccattagcctatcctgcgcaggaagtactgttgtcacgcgagccacggctagcagcgcaaggatcccacggtgcaagccgatccggttggcctaccgacaaaacgcgcctgtgggtctacagcgacaacggaacaccgacgaacatcggcaagagagtagtgtggcagggcaagtcatttgacaaaggaacgttgccttcaagaaggcctataccgccgctgccggtagcacagcagcagcgcacgctcgctgtccagcagtacctgggcacgggtggtatgacccccttgacccgcgggtcacccgtatcggatttccctgtccatcaagtaatgccattgggtcgtcaagcaacacagccagcgacggctcgggaagttggccgcgccacagttgacccgagtcggcctacggtgccgactcaccacccagcgaggtcaacgtgatgtgttcggccggagcgcgaccaccgaacagtacggaatacccgcacccgccaagcctagaagttcgtcccgctcctcaacgccatagcataacggcaactgcagttcctcagcagagaccacctccacctccaccgcctgcagcgataacattttcaactcggacatgagccggtcgcaggcagtccgattgcttgacgggccattcagtttccaatgcaccccgatcggcggtggcattctcggtcaacggcttggcgcaccaccacacccgagtcaactcttcgacattagcggtgacggcgtaaatggtcagtcgggtaacataccactcctgcggccatcagtgcctgatgcagtgcgccaatttgtacagatgcggacgttcgagttcgccatgggccggaccggtgggcggctaccccataagcgccgaacctgtgaggccacatcagtaaccaacagtgcggcggtcaaccagatcggcaagcaccgcgttgttacctgctgtccggacccgaaatagcgggccgttcctcgcatgacaacaccaaaagcccgagccggcaacacctcgaggcggaacaccagatcgtccacggccgcgatcactccctcaaaaaaatgggcgccgcggtcaatggcaacagtcatgacgtacagttgcgggcatcggaccgccacctcacgacgtcgcagccctcgccggactacccttgcgaggggcggcccgacgagtaggaagtcacccggttagccaaagtgaccacgaccgggactgtcgcgaccgccggccagtccatgaaccaaatcgccaacatccgggatgatgaagtgaccggaaatcgcccaggatagctaccagacactcaatcctgtcttccaggacacaggccactgaccctcacccggacctcccgacgtgcccgaatccgagagtggatgcgccttggttgctcatcgtgatctcatagccatagactcggccctccaaccgagtcagaatcccttgccagtcaccatcggtgaccagcaagatagcaacaacctcatacttttaacacaggttaccactgcccgcgcccaagtgcgcggcaccaggtgcccacatagaccaagtaccaccagaaccatgccgtcaacaaacaccgctaaccacttccactggatcagtcgcggtacccggtatcaccgcgagccggctcagatccgcccccagactccacagcggctagcagtccgacatcaggcagaccaacgggttgacccaggcggccgtcaccacaacaaccacgcccaacagcaatgaccgagctgacaacaccgccaccgtcccccgcgtaatgtagtacattgccggcccctcgggtccagcgcttcagcaagccactgcgggacagccagccgagattccggtttcggtagcagagcaggttacgacttgcctggacgccttttcagacatcaaagccatccgacggcacaatgcttcgagctgatcagcgcgattctcataccgctggtcaggggctaaagccgcggtcacgactagcctcctaccagatttatggagacacataactcgaattcatgctcgggcaaacacctggcctccgccacccgtcaaccatcgaccgccgactcgtcaacgaggcctgccagtattgaaattcagttactattatctacggcaagcgcgcggacgaaaaatgctcagaagccttaccgcacaacaattgattcaactcatgtcagacggcgtaagaccaaactgtcgatgcgcctgacccagcgtcactgccggccccacgaaaggactcctgatgagcacaggaacgagtgtaccactgcgcgtggctagcattatgctgatcctgggactgctaccagcaatcctgccggcgtgtggtttctcagagtcacatcacaagctgaccatcggcgtgtcctatcctaccgcgaacagtccgttctggaatgcctacacacgctttatcgacgagggaagccaccaactcggtgtctatatcaatgccgtgtcggctgaagaagacgaacaaaaacaactgtccgacgttgagaccctcatcaaccaaggcatcgacgggcttatcgtcaccccccagtcaacatcgatcgctcccacgctgctgcggatagccacccaggcaaacatcccggtggtcgtagtcgaccgctacccaggatatgccccggggcagaacaaaaacgctgattatgtggccttcctgggacccaataatgagaaagccggaagcggcattgctgaagcactcatggctggcggcgggtcgaaattccttgccctcggtggcatgcccggcaactcggtggcccagggccgcaaggctggcctggaatcagcgctcacggcagtcggtcaccggcttgtgcagtttcagtacgccggtgacagcgaagacaaaggccttgccgccgccgagaacatgctgcaagcacaccccgccggcgacgccaacgccatctggtgcttcaacgacaaactctgccagggcgcaatcaaagcagtatacaacgccaatcgtgaaaaggaattcatctttggaggaatggatttgacaccgcaagcaatcgcagcgatcgaaaacggattgtacaccgtcagcttgggcgcccattggctagagggcgggttcgggctggcaatcctctatcgcaaaatccacggccaagatcctgctgagcggatggtgaagctcgacctgctcaaggttgacaaatccaacgtcgccaagttcaaggcccgctacatcgacaacacgccacactacaactggaagtccacaaccccgttcgatatgacgatcaccttgaactgatcaaaaaatgtccgatctgttccagacaacccgtactaggcaactcctatggtgctttgtaagcgcttaactggactcagaacaccgtcgccgcagttgaacccacaacaaaccctgggtttaccaacgagaacggcaggggatgcttagccaggactggaacaatagtccagacgctggctgagcgaccaagcaaatcaccaaaaccgttacacatgaactgggcgaataccacaacgtcaaccgaaccgcacatcgtactcaagcacagttgtactctctgatgctgtggccgacattacatcagagggcgtggatcacacgacgaagtgtgacgccgaacaatacttccaagcgattgtcacatcaatggccgacggagtcattgtggtagacatcgacggacggattgagtccattaatcccgccgctactcggatattgggcttacgagcccacgatgtcgttgacatgaagcatggccatccattctgcttctacgatacagacaatcagcgggttgatcttgagcgtgaggtcatgcgcgtcgtacgacgcgaagtaacaacggtaagcaaagtcgtcggcattgaccaacacagtggccagcggttatggctatcggtaaacgtgagcctgcttgcgtacaaggctcccccacactctgcactggtagtctcgttttctgacatttctgcccaccacctttcgatcgaacggctcacctacgaggcaacccacgactgtctcaccggtcttgccaatcgcaggtttgcggaagaccagatcaccaaatcactgcagcatgacgaacgctctcgattagctgctgtactgcttcttgacctcgacgatttcaaagtgatcaacgactcactaggccacgacgtaggtgacgcggtgttgcagactgtagcgcagcgactacgctcggctgtgcggcccgacgatgtcgtcgcgcggctgggcggagacgagttcatcgtactactccggggtcccctttcggacatgaatgctaacgacgtcgcaaaaagactgcacacaacactgtccgagtcactcgtggtcgaccagctcacggtgcctatcggagcgagtgttggcatccttgaggtgagacctgacgatcgacggcgggccgccgacattttgcgtgatgccgactccgcgatgtatgcagccaagaacaagaaacaatgtgccgtcacgccgcagcagctggtaccgttcgtcgcgctgatcgcactgtttgtgttttttacagctgcggccggagctaagttctatgcaccatcaaatctgctggtcattctccaacaaaccgtggtgctggcgatcgtcggatacggcatgactttcgttatcatggcaggctccgttgaactatcggtgggctcgatcgtcgcattgactggagtcaccgcggcactcgtggctgcacagaatcaattcgctgcgatcgtcaccgccctgctggtggggttggctgctgggatggtaaacggcatcgtttttgcctacgggaagattccgtcattcgttagcaccctcggcatgcttcaagtctgccgtggtatcaccctgatgatcagcgacagttctgccaaaccgatgccgtttcacggaatactgggtgcaatgggagccatgccgtggatcctcatcgtctgtcttttcgtcacaatcctggcagggatcttattccaattcaccatgtttggtcggtgggtcaaagccatcggtggcaacgaacgtgtcgcaacgttagccggggtacctacccgcgggatcaaagtcgcgatcttcgcgatctgcggactgacagcaggcctcggcggtatcgtgcttgcttcccgcctcggagccgggacacccaccgcagcaacaggtttcgagatcgatgtcatcgccgcagtcgtcatcggcggcacgcccttaaccggcggattgggacgactcagcggaacgctgatcggtgcaataatcatctcgatgctctccaacggcatggtgtttatgggtgttgggaatgccgcctcgcagatcatcaagggaattatgctcgccgctgcggtttttgtcttcctacaacgccgcaagatcggcattatcaaatgataaacgtcgtatcatccgagtcagcggcactaaagccagtgcggtcattcaccctgcttagctaactccctgtaccaaacaacaaacacctgaaacaaagttttgagaacgccctatgagtgagcacaacccagcaggggcgccaggggcgtcgactgaggtaagagtagccattgtcggcgtgggcaactgcgcgtcctcgctagttcaaggtatcgagtactaccagaacgctgacgacacatcgacagtgcccggtcttatgcacgtgcggttcggaccctaccatgtgcgtgatgttaaattcgtggcggccttcgacgtagacgccaagaaggtcggcgtagacttgtcggacgcgatcttcacctcagagaacaacaccatcaagatcgccgacgtgccacccaccaatgtggtggtgcagcgcggcccaacactggacggcatcggcaagtactacaccgacaccattgagctgtcagacgttccacccgtcgacgtagtccaggcactaacagaagccaagacagacgtgctggtgtcctacctgccggtgggttccgaagaagccgacaagttctatgcccagtgcgccatcaacgcccgcgtagcgttcgtgaacgcgctgccggtgttcatcgcctccgacccagtgtgggccaaaaaattcgccgacgccagggtaccgatcgtaggtgatgacattaagagccaggtcggcgcaaccatcactcaccgggtgatggccaagctgtttgaggaccgcggggtgcagctggaccgcaccatgcaactcaacgtgggcggcaacatggacttcctgaatatgctcgagcgcgaacgggtgcaatccaagaagatctccaagacccaggccgtaacgtcgaacgtgcatcgggaattcaataccaaagacatccacatcggtccgtcagaccacgtcggctggctcgatgaccgcaaatgggcctacgtccgactggaaggccgtggtttcggcgatgtgccgctgaacctcgaatacaagctcgaggtatgggactcaccgaactcagcgggcgtcatcatcgacgcggtacgggcagcaaagatagccaaggaccgagggatcggtggaccagtgatcccggcttcatcctacctgatgaaaagcccgccgcaacagctacccgacgagatcgcgcgtgcccagctcgaagagttcatcatcgacaccaaataacggttccgcattcaccggcaaccctgagcgcccgaggagcgccagcgacgtgatgtcattccggaaagttttcggcgaccgctattcccactcgatggtgccgggcggtttgttggtgatgtccaacaccacgcggttaacctcagcaacctcgttggtgatacgcgtcgagatgcactccaacacctcataaggaacccaggtccaatcggctgtcatggcatcctcgctagacactggccgcagcacgatcgggtgtccgtaactgcgattatccccctgcacaccgaccgaacgtacgtcggccagcagcactaccgggcactgccaaatctggtagtccagacccgccgtggtcagctcctcacgcgctatcgagtcggcccgccgcagcgtgtccagccgttcggcagtcacctcaccaacgatccggatgcccaggccaggacccggaaatggttggcgagcaacaatttcctccggcaggtccaactgtcgaccgaccgcacgcacctcgtctttgaatagcagccgcagcggctcaacgagcttgaaccttaggttgtcgggaagaccaccaacattgtggtggctcttgatgttcgcagtgccactgcccccaccggactccaccacatccggatacagtgtgccctgaaccaagaactcgatcccggaatcaaaagtgctgtcacccaacaaatcccgtactgcaccttcaaatgcccggatgaactggcgtccgataatcttacgcttgccttcggggttggtcacacccgacagcgcctgaaggaaagtctcggccgcgtcgacggtaaccagcttagcgccagtagcggcgacaaaatcacgctgcacctgtccgcgctcaccgtcacgcagcagaccatgatcgacaaagatacaggtcaatcggtctccgatggcgcgttgcaccagtgctgcggccactgcggaatccacacctccagacagtccgcagatcgcatggccgttgccgatctgggcacgcacctgctcgaccagcacaccagcgatgttggcagccgtccaatccgcgtcaagcccagcgaaatcgtgcaagaaccggctgagtacttgttgcccgtgcggggtgtgcatcacctccgggtgatactgcaccccggccagacgccggtcccggttctcgaaggcggccactggggcacccgagctgctggcagccacgtcgaatccatcgggcgcggcggtgaccgcgtcaccgtgactcatccagaccggctggacaccaggaagacccgaatgcagatcaccgccaaggactttcagttccgtccggccgtattcactggtcttggttcgggcgacagtcccgccgagcacctgagccatggcctgaaacccgtagcagatcccgaacaccggcaaaccgaggtcaaacagcgctggatcgagctgcggagcaccttccgtatagacactggccggtccaccagaaagcacaatcgccagcggatcacgggcggtgatctcctcgatcgaggtggtgtgcggaattacctcggaaaaaacccgtgcttctcgaacccggcgggcaataagctgtgcatactgcgcaccgaagtcgaccaccaacacggggcggggcgagggttcgggctggtcgaggccagcagagtcggccacgggcagccagtctagaggctggcagcagctcccgaggcaagcagcaacgcacagggctgcctcgcgatcaactccacgccgacaaccgcctgttgttcccccagcatcaatccaccgagagcacaacgcggcacgcaatgcgtcgatggcataacgatcgccggtggcatgggttcgccgcatagcggccttgtacttggcttcggtcccccgaggggggactgtgacaagtgcatcggatcgagctcagtcaacatgaagtcccagacctagcgtattaagtattgccagcggtacggcgcaattttgagacgatgacgtaacggtgtgcaattgtcaagaagtcttcgggttcgacaccaacgacatcgcgaacataggtgatcatgccgtccattttccaggtccctagcacactgtctggacgaattcgatcggctacagcagccacgggccgcgcacttccaattttcgggtcggtacgccgcgtagcgcagctagaacaccgcctggtgcacgtatgaatgacaagatttgtgcccagtactcgaccggcttatagcaaggataacatcgaacaactctgatcaatgttgaaaaggaacctcgaacaccttgcggctgcggctcgtgggttgcgcgaagacttcccacacaatgggtcgcattgctaccagccaactcatgtaccttatcgagatcacaagtgaaaccaaggcacttgacgggggcagcgccatcggcggaacctcccgttttgccgcagaccaaagacgctgtcgagtcaccgccgtagatctgaccagagagtactacgacacggcacgttggctaaatcaacttgtcagcttggtcaagcagatcttcgttcagcaatcggacgtaaccaaactgccgttcgttgacgccacctttcaggtcattttcagccaacacgttcatctgagcatggcgaacaatgcccacctaatactccgaatcacaccgggtattgatctacgagagttgacttgccatgtggaacatcaccatatcaaaaagcggctaactctactatccggagccatggcccgacgagcccagccacagccatctcgtcacctccaaccagttacgagtcatcattgagtcctacagcttagcaatcgagcactggaacgatcgaacggagcaggcgaccacactcatgcaagccgtgctgtacctgtcgtccaacccgctgggactacacgcgttcgtcgccaacttgtagcacaacaccaagaaacttcactcgtgccccttgccggccagcggttacaagtcatccaggacatgtcacgaaccgtcaccagaacagcaaagcgagagcgtgtagtagcgaatatcgaaacacgaacatgagcttcacagtttttgacgcctgagaatcgttatcgtctcaacgaaagtaactgttaaacgaacaaaaaaccaggtcaaatgtaaactcctatacaaacagccgtggcttgacggttgggccgttgacgcaaggccggctcggcaatgcaatcagcgccgacacattaggtacgctgcatcccggtgagcccggactgtgcagccagcccaacagtgggcatggcgaactgggatcacccaactagtaaagtgaggtccaccgtgctgggtctgccggagcaagtgcgcgcctgcctattcgacctcgacggtgttctcaccgataccgcgagtgtccatgccaaggcatggcagaccatgtttgacacctatctataccaacgggccaagcacaccggagaaaattttgtgcccttcgaccccaccgcagactaccgacaatacgtggacggtaagaagcgcgaagacggggtccggtcatttctgggcagtcggggaatcacactgcctgaaggcagtgccgacaactccggcgacgtcgagacaatatatggcctaggcaaccgcaaagacgacctattccggcaggtactcaaggagcatggcattgaggtcttcgacgggtcgcgacgctatctggaggcaatcacgtacgcaggcctcggcgtcgccgtcgtgtcgtcgagcaccaatacccgcgacgtactcaagatcaccggtcttgaccgatttgtccagcaacaggtggacggtatcaccctgcgtgaagagcacatcgccggcaagccggcccccgactcatacctgcgcggggcgcagttgctcgacgtcgctcccgacgcggcagccgtattcgaggacgccttgtccggcgtgcaggccggcctgtccggtcacttcggcttcgtggtgggcatcaaccgcacgggtcgggtagaccaggccgaagaactgcgccgcatcggcgccaatgtagtggtgaccgatctcgctgaactactgtagggcatcatccccgatgatcaccgaagaagccttccccgtagaaccttggcagattcgcgagacccggctcgacctgaacttactagcccaatcggaatccctattcgccttgtccaacgggcacatcgggttgcgcggcaacctcgacgaaggcgagccgtacggcctgccgggaacctatctgaactccttctacgaaatccgaccgctgccatatgccgaagccggatacgggtatccggaggccggtcagaccgtcgtagacgtcaccaacggcaagatcttgcgtctgttcgtcgaggacgagccgttcgacgtccgctacggggaagtaatcttccacgagcgagtcctcgacctgtgcgccggaacgctgacccgccgcgcaaattggcgctcgcccgcggacaagcaagttaaggtggtgtccacccgtttggtgtcgctggcgcaccgtagtgtcgcagctatcgagtacgtcgtcgaagcgctggacaaattcgtgcgcgtgaccgtacagtctgagctcgtctccaacgaggaccaacccgagacctcgggcgacccgcgagtgtcagccattctagataacccgctagaggccgtcgaacacgaagccactgagcgcggcggacttctcatgcaccggacccgggcgagctccttaatgatggccgccggaatggatcacgaggtcgaggttcccggacgagtcgagatcaccaccgacgcgcgtccagacttggctcggaccaccgtgatctgcggtctgcgcccaggacagaagctgcgcatcgtcaaatacctggcgtacggctggtcaagtctgcgctcccgcccagcgctgcatgaccaggccaccgccgcactgcacaccgcccgctacagtggatggcaaggattgctggacgcgcagcgcgcttacctcaacgaattctgggacagcgccgacgtcgaagtcgagggcgacccggaatctcagcaagcagtgcggttcgggctatttcacctgctgcaggccagcgcgcgcgccgaacggcgtgctatccccagcaagggactcaccggaacaggctacgacggccacgctttttgggataccgaaggtttcgtgttgccagtgcttacctacaccgcgccgcatgcagtcgccgatgcgctgcggtggcgtgcgtcgacattacagctcgccaaagaccgggcagccgaactcgggctcgacggtgccagcttttgctggcgaaccatccgcgggcaggagtgctcggcgtactggccggcgggcacggcggcttggcacatcaacgccgacatagcgatggccttcgagcgataccgcattgttaccggtgaccactcgttggaggaagaatgcggccttgctgtgctcatcgagacggcccggctgtggctttcactcggacaccacgaccggcatggtgtctggcacctcgatggggtcaccggtcccgacgagtacacggcggtggtccgtgacaacgtgttcacgaatctaatggccgcgagcaatctgatcaccgctgctgatgcctgcctacgccagcccgaagcggcaaaagcaatgggtgtcacaaccgaagagatggccgcttggcgcgacgcggccgacgccgccaacattccgtacgacgacgagctcggtgtccatcagcagtgtgaagggtttaccacctttgcggagtgggattttgaagccaacaccacctacccattattcctgcacgaagcctacgtacggctctacccagcacaagtaatcaagcaagccgacctggtgctggcgatgcagtggcaaagtcatgcgttcacccccgaacaaaaggcgcgcaatgtcgactactacgaacgacgcatggtgcgtgactcatcgctgtcagcctgcacacaggcggtgatgtgtgccgaggtcggacatctagagttggcccacgactatgcttacgaggccgcgctgatcgacctgcgcgatctgcaccgcaatacccgtgacgggttgcacatggcctcactcgccggtgcgtggacagctctagtcgggggcttcggcggcctgcgtgacgatgagggcatcctgtccatcgatccccaactgccccacggcatctcgcgtctacgattccgactacgctggcgcgggttccgactgaccgtggacgccaggcatgccgacgtcacctacaccctgcgcgacggccctggcggcgagctaaccatccggcatgccggtgaacacctcacactgaaatcggattcaccgtcgaccatagcggtacgggaccgaaagccactcctgccgcctccatcacagccgccgggccgcgagccagtaagccggcgccataagtcgctcataatcagtgcggctcgatgagccaggccacctcggcgtgcacggcccgctgaagctgcgcttcggtcaggtcggcgataccgataaccgaatgcagcataggagtaaataattgctaaccaaattgcggcgcaaggaaattagcgactgccagcagtgcgctgcgcggtcgcttctgtggcgtggccgcacgccatctagcatctctgcaacgttgggaaattgcttctcatctgccccacgagataaccgtcgaatagtgtccgggtcaggaccccatatgccgatcgagcccacgttcgacgacgtcacctgacgccgcgtagtgcagcaaaccggtcagcgtcatacccaagtgatatagcacagcacccaccaattgttctttttggttccgaagggccgaaaaaccagtccatcgttgacccccgatcgggcggcgatatcgcggatagatgtcgcggccggaccgcgctcggcaaacaagtcagtggcatggctccgcaacatcttcccgtccggcgggagccttgcgtgagcgggttgccgagggtgcagtcatatgactgcactagtcgatgcgatcgaactgactacgtcagctagtcccaaaaggatgaaatgaaatagagtacacacacgataaacgtcacccagctaggcagccggatcgggtcgaatcgataaccgacacacagcgggagttccgggaggcgttcgagaacccggttttccggaacgaacatccggtcgtgcgggtgcacccgaagaccggtgagcccatgttactgttgggaaattttatgcacagcctcgtcggtctggacagccacgaaccaagcgtgcttttggagttgttacagcgacaaatcaccatgcccgaaaacaccatccgctggaaccgggagccggtcgacgtcaccgttgaggacaaccaatcacacaacaccaagcaaccgacaactacgacaaccagccacacctcaatgcacagggttaccttggtgggcgatgttccggtcaacatgcacgacgaacacagtcggatagtaagctgtgcgccactgagcctcagccaacgcagtggcgtcatccagcgttacccacccgtccggatcaatggctatagccaccgcagcgctcccagcgcttcggcgggcaccaccgggtggtccggggcgatcggggccagccgacggtacgactcaccctgccgagggcgctgatcgtgctggcccttgttgggccacaaggaggctgcacgctcagcttgcgcagcgatagacaacgatgggttgacgcccaggttcgccgaaatcgctgcgccgtccaccacgtacagtgtaggatagccgtagactcgatggtaggggtctatcaccccgtgttcagcgttgtcgccaatcaccgcaccgccaagaaagtgcgcggtcagcgggatgttgaaaagctcgccccaggtaccgccggccacgccgtcgatcttggcggctagacggcgggtgacctcgttgccgatcgggatccacgacgggttcggttctccgttcccctgtttgctggagtaccaacggatgcccagtttcccccgcttggtaaacgtggtgatcgagttatccaagtgctgcatcaccaacgcgatcaccgtgcgttcgctccaccgacggggattaatcagccgcagcatgcggcgcggatcttcgctggcctgatgcaataactgcctccagcgcggcacatcggtgccctcgggaccgggcccgtcagtcatcaaggtctgcaacaatcccatcgcgttggaccccttgccgtagcgtatgggttcgatatgcgtgtccgacgtcgggtgaatcgacgacgtgatcgccacgccatgcgtcaggtcccggtcaggcatgacgttcaaggtcccagcaccgacaatcgactccgagtttgtccgagtcaacacacccaagcgctgcgacagacgaggcaacttaccttggtcacgcatcctgaacagcaaacgttgcgtcccccacgtgccggcggccagcagcaggtgtgcagcggtaaacgtgcgtctgcccctgcgcagccaactgccggtgcggaccgtatgaacttcccacagcccctcggaccgcagttcgaatcctttcaccgtcgtcatcggaatcacttgcgcacctgctgattccgctagaccaaggtaatttttcaccaacgtgttcttggcaccgtggcgacaacccgtcatacagcaaccacattccaggcagccggtgcgcactggccccacgccgccgaaatacgggtcggccacggtccgacccggcgtctgagtgccatcagggccgaaaaacacccccaccggcgtcggcacaaaggtgtcgccaaaccccatctcatcgacaacctctttgagtatccggtcggcgtcggtgaaggtcgggttacaaaccacacctaacatccgctgcgcctggtcgtaatgcggcgccagctcgctgtgccagtcggtgatgtgcgcccactgctggttggcaaagaacggctccggcggaacgtacaacgtattcgcgtagttcaacgaaccgcctcccactccggcgccggccaatatcatcacgttgcgcagcaggtgaatgcgttggatgccgtagcagcccagcttcggcgcccagaggaatttacgcagatcccaggacgtcttggcaaaatcctcgtcggcgaagcgacggcccgcctccaaaacaccgacccggtaacctttttccgtgagccgcagcgcactgacactgccgccaaaccctgaaccgatgattaagacgtcataatccggcttcatcgccccagtatgacccgccttaggcaccagcgtgcgggctggtcgcacgtttggcgaccgaacctcagatgctgacgatcagaccgaccttctggaattccttgaggtcgcaatagccggccttagccatagatcggcgcagaccaccaacaagattcagggtgccgaatgggttgtcggagggcccgttcaaaacctgctgcaatgacggtcgctcaccgacagcggtctgtagcaacgccccgcgtggcagagacgggtgcgccgccgcggccggccagaaccacccgccgccgagtgcctcggcactttgggccaacggtgtacccagcaccaccgcgtcggcaccacaggcaatagctttggccaactcgccagacgtgtagatatcgccgtcggccagcacgtggacgtagcgaccaccggtctcatcgaggtattcgcgccgcgcagcagccgcgtcggcgatcgccgtagccatcggcacgctgatgcctaacacttcatcggaggtagtggcccctctagtggagccatagccgacgatcacgccagccgcgccggtgcgcatcaggtgcagcgccgtgcggtggtcgagcacaccgccagcgaccaccggaacgtcgagctcagagatgaatgttttcaggttgagtggttcaccaccgctggcaacacactcggccgagacgatggaaccctggacgaccagtaggtcaattccggcagcgagcaacaccggcgtcaacacttgggcattttgcgggctgactcgcactgcagtggtcactcccgcctcccgaatccgagctaccgccgaacccagcaggtccggattcagcggcgcagcatgcagttcctgcagcaaacagaccgcagtcgccggttcaggctctttctcggcagcctcgatcaactgtgcgaccttggcaccgacatcagcatggcggccaatcagcccctcaccgttgagcacacccagcccaccaagccggcccagctcgatggcgaactccggcgacactaacgcatcggtcgggtgtgccacgacggggatctcgaaccggtaggcgtcgagttgccaagccgtcgacacgtctttcgacgagcgagtgcgacgcgacggcacgatgctgatctcacggagctcatatgttcgacgggccacgcggcccatccctatctcgaccatgtcgggcgtcaacgcgggtaatagttgggggcttcgacagtcatcgcaacgtcgtgcgggtggctctctttgagtccggcgggcgttatccggacgaactgtgcctgctgcaacacctcgatggtaggagagccggtgtaacccatcgcagcgcgcagaccacccaccagctggtggatcactgacgacagcggaccacggaacggcaccctgccctcgattccctcagggaccaacttgtcctcggacaaagcgtcgtcggcgaaatagcggtccttggaatacgacttatccccacctctaccttgcatggcgcccaacgaccccatgccgcgatagctcttgaactgcttgccattgacgaagatcaactcgcctggtgcctcggcagtgccagccaacaaagaacccagcatggtcgtcgacgcgccggcggccagcgccttggcgatatcgccggaatactgtaacccgccgtcggctatgacaggaacgcccgccggtccgcacgccgcgacggcctccaggatcgcagtaatctgcggcgcgccgacaccggccaccacacgggtcgtgcaagtagacccgggccctacgccgaccttcaccgcgtcggcgccggcctctaccaaagctgccgctgccgacctggtagcgacattgccaccaatcacctggacccggtcgccaatttcgaccttgagtttgccgaccatgtcgagcaccaaccgattgtgcgcgtgcgcggtgtcgacgatcagcacgtcgacaccagcgtcgactaacatcatcgcgcggacccaggcatctccgccgacaccgacggccgcacccaccagcagccgaccatcgttgtccttggtcgccagcgggtgctgctcggttttaacgaagtctttgacagtgatcagcccggtcagccggccatggccgtcgacaacgggcagcttttcgatcttatttcgccgcaacaaacccaatgccgcgtcggcgctgacaccctcagcagctgtgatcagcggtgttttggtcatcacctcggcgacctgtttggactggtcgacctcgaaccgcatgtcgcggttggtgatgatgccagccagtgcaccggaatcgtcgaccactggtaacccggagatccgaaaccgggcgcacaacgcgccaacctgggccaaggtgttgtccggccggcaggtgaccggatcagtaaccatgccagcctcagaccgcttcaccgtctcgacctgtccggcctgttcgccaacaggcagattgcggtgcagcacgcccatgccgcccgcccgagccatggcgatggccatccgtgcctcggtgacggtatccatcgctgagctgaccaacggcaccttgagcctgatcttcttggtcagctgactggaaatgtctgcagtagcaggcaccacgtcggaagctgcaggcaacagcaggacatcgtcgaaagtcagccccagcatggccaccttgtgtgggttgtcacccccggtcgcggctgggtcgtccatcaggccaccgaggcgcacgtacgaactggcaacgaaatcggagctttctttcaggttggacatgccacggatcatcggtgcggccctccatatgcatgcggagtgagaaatcccatcttataggcttaccaatcctctgggctcgcttggccgggtgttgtgccggtgatgaaacaacatcggtcttggctgctggcattattgctgcctgcctgcgtaggctagaggcgtgcgtgaccacctaccaccgggtttgccacccgacccgtttgctgacgacccctgcgatccgtcggcggcgctcgatgccgtagagccaggtcaaccgctagaccagcaggagcggattgcggtcgaagccgacctggccgacctggccgtttacgaggcactgttggcgcataagggaattcgtggacttgtggtgtgctgtgacgaatgtcaacaagaccactatcacgactgggacatgctgcgtgccaacctgctgcaactactgatcgacggcactgtccgcccgcacgagccggcctacgaccccgaaccggactcctacgtcacgtgggattattgccggggatacgcagatgcatcgctaaaccaagcgacatcagacgcggatggctatcgccgccgtcactgatgacgcagcatttgcgctcgatcaatcggcccgaaaaactagtagcactgactacgtagtagctagccgaccacacggttaatgctgaggcagagcgtctagcaaccacctcgggcaatcgcccttcaagatgtcacggttgtgtgtgtgtcatgcaccccgtccaaaagaccccaggaataacacagcaacgacacacagatgctcctagcagctaacgtcaactgtcattcacatctaataatatgaacctaataatgaaccgttgtgtagtcgctgctgttcgggtgatcagaggtgtagaaattataacaatccagctcatgcatagcacggctgggacgcaacacccacaagtcaactggcttaccgtttactgatgtgagaactgtggccgggtgtcgatactcatgcactagtctatgctcaccccttgggtaatagcttctagctggaaccgagagaagtcctggatttacgccactgagaacgaagtaggggaagttagtccccgcgtgtaaaacgatgagggcacatctgggtcccccatcaacccgtcgaaatgccgtagtgttgtccacactatatgcaccgctcagctacgtctgatggcttactgtggacccgccccacgcagattagtatttggttaagtccgtgccgcgcagatcggctacatcaaacctaacgtccctaaagtccacgccggtgaaattacggccacgacaagtcctcgcggttggctatctagccaaggcaactggtaagacaccccgcttccccagatgcatagaccacgccactagaccctgccatcagcacaacaacgacatctgccatcaaccctgcagaacccagccggctaccaaacccaccattcatgtgactcctgcaccttttctcgttctgcttttttcagacttgttttcaaacgcttttgatctcacatcgcacagtccacagcgacagcagcgctaggaccacccataggcaatcgacatcaggcaccccgccaaacaatttaaatccagaatccagcagaaccggtcgacagcacgcttgcaccatcgtgtcttcgagatgaaggtgcccaatccccgcggccaactccaaataaaccgagcccgaacagtgtactgatcagatccgcgaaccaaccccgatacatgaatcacccaacaaatggacagtacaatgcgatatatgcggatgtaagcttatgaagcaaacgaacgacgtttgttgtgccatacagcaccaaggtcagagccatgtaactgaccacgcagcaggtgaataatcttggaaggcggtggtggccgcatcacttgcctcggtaaagtcacggcaccgctttagcttagagcatgacgccgggcggctctgaagaagaaacttgcgacagcctgtgatggtggtgttggctcgccggtggaatcgacaactaggtcgaggactagccaggcggcgcaggaaccggttatgcccgcctccagcagaggcttagtggtcaaggtggttgaggcggccggcaccggcaacgaggcattcgggttgtgggtctccaccttcgtgttcaacagatttatttcattcatcaggtcatctctgcggttatcgtcttctatcgattacacgctgctgctaacctcagccaactgattctcagtctgataccattggccttaggcgatcagatcatttgttgaaccttggccagttcggtcttggcggacaacacaatttgattattattgacttgcgggtgtgttcaagaacatcgtatgcaatccggacaatatccgtccgggacgggtatcagccaccacggcgaccagtccactcagaactagcagagtcactgccactgatccgaccgctcccaggccgcgaggagtgagccggctctgcaatcccagtgcacagcgcctcgacggcctcaccttaggacaccaatgcgctggccggtggggcccccacctcaagtcatcacgtcagtccgccaacaacgcggccagcatgtcatccaccgggatcgtcgacgtcgactatgacgttcggcgaacacatctaagagcagatcatgcgggccacctcgtccaaagcgagctgctccggaagcgcataaccaaattcaggcataatcacccgccgcgacgatctcggacgtcaaccgcaacaacgcgcggtgctgggctaccccggaccgtcccggtattgctgcctacagcggcggcgatctcctcggcagacaggccgacgaccacacgcaggatgagaatatcgcgctgcttggcaggcaagatctcgagcagttcgttcatcagtgtgaccgaatcggcttggatgaacagctgctccgggcccgcgtcggccgaccagcgctcgggaactgctccggctagataggcaaaaaccgtggccggcagaccgatgggcgtcagctacgttgtgggcgatgatgccatgcagaaaggccaggaaaacgggcatcccccggtcccggtagctgggcagcgcgattatggccgccaagcaaacctcctgtgccaaatcgtcggctgacagaccactccgctcaaccgtgtcgattcggtcgattcgagcgcggcaatatcgcacgacgatcgagcgaatggtctccagcacttcgcgaagtgcattcctgatcgccagtcacggcctcagccaccacagtatcgagacggtcccattttaaactataattacggcggtctcgccaacgctacggtcccggacacatctcaggctaagacacagctaagcaataacggccagatgccatgtcacgcggtacgccaggttccaccggcacgccgcacctggtctgcgcagacatcgcgaagctcggacaactccggttcgctaaacgtgacgcttccgatatcgatcagcaagcaagccagtgcccagcgaagtggtatcaaccctaatcggccagtggccgccagtgccgcctcagcgacgacgcgggcgcgctcagtggcggcgctgcatagggcggcggccagcacgacatcacttttgacctggtgccgcaccgacacgactctcccaacctgggccagttcaaccgcttcccgggcgtgacgcacagcagtcgccccgtcacctacggccatcgctaattcagcggccacccagcgccgacgcaccgccaaccggtccgccacctgagccggcaattgtgccggagctagcgccgagcctacgcgcctcaacaatgtcgccgcggcgccaaacggccgacgccgagcgcgtcggccgccagcccgatcaatgcatcggcacgagcctcggaatcggtgccagccagcaccagggcacgaccatcccaaccccgcgccaacgagtgccaaccgagttggcgcaagaacgatccgtgtgtactgtgcgccagcgaggccagcctcccggccggaacgctgcgtcgcaacaccgccaggtcgcggtaggcgctgctgtagtgaccctgcccaccggccgcaacggctcgcaaccacagttggtgaggtgtagtagccgtcggcaacggcaacggcccggctggtttccaaaggcagcggcagcaagcattggctcagccgccgaagtgtgaccaatttcaaccacaatgctaaccgaggtcactagtccaatctgtgtagtgtctacgttaccgaaatattaacccaggtccacccgtagcctaattgccgaagcctagacataaggactcggaactggaaaaacttggcatcgataggctcctccgtacagcaagttttacattcggcgaaaacgtcggagatgaacgcagtattaattctcgtgcaacccttacacattttgccgcggagagtggctattgactctaattcgtcagcccacttaccgtctaatgttgtcgggtagtcatcgatgacgccactccaaaatcagtgtgcacactcacgtacgtttgtgaacccaccctccacttgggcgtaccgtgcagagagggaatacgtaatgccacagcctaagcagctacctgggcccaacgccactatctggaactggcaactgcaaggcctgtgtcgcggcgttgattcatcaatgttcttccatcccgacggggagcgtggccgtgcccgtatgcaacgcgagcagcgcgctaaggaaatgtgccggcgctgtccggttatcgaggaatgtcgtgctcatgcgctggacgtcggcgaaccctacggcgtttggggcggtttgtccgaatccgagcgcgacctactcctcaagggcgatctcgcgcgcagccgcagtatccctcgcagcgcctaataaacctggcttggaccagcaccggttgcaagccaccctaggtcaacctaaattgcgtggacgctaatccgtcggtagcgtcgcgcgtcctggccgcgtttaccacaggtttccgagcaccattcgcggcgagggtgagatctgacaaaatagacaaaatatataccacgcatccggggccgtggcaggtgcgcagcttgatatcgctgggtcctgtgaacatgtccaatcgagtcacgcgcgagttcggctaaggcgacgcgggccagtgaaataggcaccggacgaccgtggtgcagccgaccccccgaataacgagttgagtgtagggcagcttcttagctgcccaatcccccaggtcaacagcgttgccgatgctgttgacctgggggattgggcagccagtcggagatcggctatggcgaaagcgggtaaccggcgaagggagtcctcgtaacagcttggccccggccagctcggcacgacgggggtctccgctaactttggcagcgtattgccctctgctgtgaaaccgaacgcatatcaactagaaagacccccggtatccgggggtctttctaggggtacgcactggctgtttagtgcgcatggccgtggtggtcatgctcttctgtcttggccggcttgtccaccaccgccgtttcggtggtgagcatcatccgcgccaccgaggccgcgttaagcaccgctgatctggtgaccttgaccgggtcgacgacaccatcggcgaccaaatcgccatagcccagcgtgctagcattcagtccgtgcccggcgggcagcccgctaaccttgtcgaccaccaccgcgccatccaacccggcgttagtggcaatccagtaaagcggtgccttgagcgcctcgaaaaatacgtcgatgccgagggcttcgtctccggtcagcgacgtacgcaattgcttgagcgccgcgccgcactggacgagcgccgatccaccacccgcgatgataccctcctcgatagacgccttcgcagccgcgacggcgtcttcgacgctttccttgcgtttcttcagcgccgtctcggtgacagcccccaccttgatgacggccacgccaccggccagtttggccacgcgctcctgcagcttttcgcgatcccattctgagtcgctgacctctatctcggcccgcagctgattgactcgcttggccaccgcgtcgttggaaccgccgccgtcgacgatgatcgtgtcgtccttactaaccaccacacggcgggccgagcccagcacgtcagtgcccacctcgcgcagcaccaggccggtttcggggttgactacctgaccacccgtcacaattgccaaatcttcgaggaaggccttgcgtcggtcgccgaagaacggggacttaaccgcaaccgccttgagcgtcttgcggatcgagttaacgacaagcgtcgccaatgcttcaccctcgaggtcttcggcgacgatcagcagcggcttgcctgactcagtgaccttctcgagcatcggcagcaactcaggcagcgagctgatcttctcctggtgcagcaggaccagcggatcgtcgagcacagcctgctgcgagtcgaagtcggtcacgaaatacgccgacaggaaacctttgtcgaagccgacgccctcggtgaactctagctcggtgtccagcgtcgacgactcttcaacgctgacaacgccgtcagtgccgaccttgttcatcccctcgccgaccagcgcaccgatctgctcgtcgcgcgaagaaaccgtcgcaacctgcgtgatggcgtccttgccggccaccggggttgctaccgccagcagtgcctcggacaccgcgtcggcggccttgctgatgccagcacctagggcgaccgggttggccccggcggcgaccatgcgcaggccgcccttgaccagcgcctgggccaacacggtcgcggtggtagtgccgtcgccagcgacgtcgttggtcttggtggccaccgacttcaccagctgagcgcccagattttcgaacgggtcctctaggtcgatctcacgcgcgacggtgacaccgtcgttggtgatggtgggcccgccgaatgccttggccaacaccacatgtcgaccgcgcggcccaagtgttacccgcaccgtgtcggcgagcttgttcatgcccacctccatggcatgacgcgcggtttcgtcgtactcaatcagcttgctcatcaggctcctttaaacgcatgccgccccggaaatcacccgtggttaagcacggggatcgccggggcggaacacggttcgttacttggatacgacagccagcacgtcacgtgccgacaggatcaggtattcctcgccattgtacttgatctcagtgccgccgtacttactgtagataacgatgtcaccctccgacacgtccaccgggatccgcttcgcgccgtcttcgtcccaccggccggggccgactgcgacaacggtgccttcctgcggcttctccttggcgttttcaggaatgaccagaccggacggggtcatggtctcgcctcgccggcctgtacgagaatcttgtcctcgagtggcttgatcttcaccttcgccacgattggagccctccactatttcgatcgggcccgggacctgcgtcccggactgtgttggtagcgggttcgggacgcaggtcccgaccggcacttggcggtcggtccagggcttaccccgaaccgaccgaattatcaggtgattcggcattcgcccgtaccctcgcatcgtcgtcgcgggtgccgacactggggtctggccgactgccatctagcactctatacacgcgagtgctagcactcaaggccggcccgctgcttcctggctgttggcgtgtctagctcaattaatctgcctttttaccaccggaaggcccgggtcgctgggcacatccaacggtgacggtggcgcggccgcagccagcagatgtgcggcgaacgcggcgatcatcgccccgttgtcggtgcagaaccgcggccctgggatccgcagcatcagccccgccgccgcgcagcgctgcgcggctagctcgcgcagccgcgaattcgcggccactcccccgacgatcaacaaagtggaaacgccgagcccggtcgccgcacgcaccgccttcatggtcaacacatcggcgacagcctcctgaaacccagcggcgacatcggccggcagcgcgtcggggtgactctcgacatatcgtgcgacagcggttttgagccctgaaaagctgaacgcgtttaggtcgtcggccggcccagtcatgccgcgtgggaacacaatggcatcccgatcgccggtacgagctaggtcgtctagcactttaccgcctggataacccaatcccagtaggcgcgcgaccttatcgtaagcttcaccggcggcgtcgtcgacggtactgcccagctcgacaatgggcgccccaagtgaacgcacctgcaacaggtgggtatggcctccagacaccagtagcgccacacactcgggcaacggtccatgttcgtagacgtcggcagccaggtgtccacccaggtggttcacggcgtagaacggcactccccaggcagccgagtacgctttagccgcagccactcctaccaacaaagcaccggctaacccgggccctatcgtggcggctacaacatctggcttggccgaaccggtcaggccggcagcagcaagcgcgcagcgtatggtggggccaagagcctctagatgcgcccgtgaggcaatctcgggcaccacaccaccaaaccgggcctgctcgtcgacgctggaagccacctcgtcagccaacaatgtcacggtgccatagtcatcgaggcaggcaataccaacaccggtttcatcgcaagaggtttcgatggccaagataatcgtgccgggcacagcagagatcgtcattgcgcctcccttcgcatgaggtaagcatcggcaccgctggctgggtagtagcgggggcgtagaccgatccgttcgaatcccacactgcggtataacgcaatggcggtctcgttgtcggtgcggacctccaggtagatcgcaccactaccggcgaaatccagcagctcacccagcagtcggcggccgacaccgcgccctcggtatgccggatctacagcgatggtgtgcacttcgtattcgaatggaggggtgtggcccaagcgggtgatgccagcataa

SEQ ID NO: 132 - DNA (genomic), 36412 bp, MYCOBACTERIUM LEPRAE; double-stranded, circular
  hypothetical: NO
  anti-sense: NO
ctgcaacggtgcactgcaatcgtcagcagagacgtaaacgatattggaatacaacggatcgcccacaatctgcacacccccaggacaccatgtgcagcctcaattggtgggtcgtccggtatgcggagtcagccgacatagcccattcgacgaaatcagctccaccagcgtctccgcgttaggcacaccgggcttgcagaacccctgcaagttgccccgatgcttgacgatgcgacctcggaccaagcacggcaatactaaggccggatcgctcgctgcacgagccaggtagatctttcttgcgcaccacaccgtgggaaaacagtgtctggcatcggtcatgcaactaacggcgggtgatgaacagccagctacctcggcggccagccgaccaagtaggtggaccgagcttagctccggcaaccccagttctcagcgcaaccgcaccagcccggcctgcgcaatgtgtcgcccccgcggcatagtggccaaaaagttcggcttactaaccaccacgatgtccgtgtcttgatgcagcaccgggattgcaaaaagcacagacacttcatccggcaggtcactattacaataagatacaataagacactagccccgctgggcaccacggtagcctcaccgtccgaatagacgacttctccattcagcactttcgcgcgggtccccgcgacacttaactgtccgctcaagttagcgacaccggttcgatgatcttggtgcgcgcctcgggtgcgctggctcgcaacatgtccgccgacacgtcgtcgggctgggcctgcgacagtacctcggcctccacccgcgcattataagtcgccacctcgcgatcgatatcctcggccgtccaacccaacaccggagcgaccacatcggccacctcccgggcacaggcgacgccgcggtgtggatattcgatagagactctcatccggcgggccaagatgtcctcgagatgcaaggcgccctcggcggttacagcgtagcgggcttccaccttcaaatagcccggagcttcctgaatcggactgagcaggtcgggtgcttcagccgccaaggccaagacgtcaccgataagcgcgccgtagcggtccagcagatgacgcacccggtaggggtgcagaccttgcaacgcggcgacgtgttcgacctgattgatcaacgcaaagtaaccgtcggcgcccagcaaacctactttctcggtgatcgacggagctacccgggccggaacgaatgcaaccgcggcgtcaatcgcgtcggcggccatcacccggtacgtggtgtacttgccgccggcgatcgcgaccagacccgccaccggcaccgcgaccgcgtgttcacgggtcaacttggaagtgtcatcactttccccggcgaggagcgggcgtagcccagcatacaccccatcgatgtcggcgtgggtcaacggggtagccaacacagtattgaccgtctgcaggatgtagtcaatatccgccttggtggccgcgggatgggccaggtcgagattccaatcagtatcggtcgttccgatgatccagtggttaccccacgggatgatgaacatcaccgacttcttggtgcgcaggatcatcgcgacgtcactgacgatccggtcccgcggtaccactacgtgcacacccttggacacgcgcacctggaatcgtccacgctgcttggacaacgcctgaatttcgtcggtccagaccccagtagcgttgaccacaacgtggccgcggatctcagtaaccgcgccatcctccgaatcgcgaacccgcacgccgatcactcggtcgccctcgcgcagcaatgcgaccacctgggtggagcatcgcacgaccgctccgtaatgcgcagcggtgcgcgctacagtcaaggtgtgccgggcgtcgtcgacgacggtgtcgtagtagcgaataccaccgatcaaggagctgcgttttaggcccggacttaatcgcaacgcaccggcacgagtcaaatgcttttgcgccggaaccgatttagcgccaccaaggcgatcatacaggaagatgccggcagctatgtacgggcgttcccaccaacgtttggttagcggaaacaggaacggcaacggtttgaccagatgcggtgccaacgtggtcaacgacaactcacgctcatagagcgcctcacgcaccaacccgaactcgagttgctcaaggtaacgcaaccccccgtgaaacatcttcgacgagcggctcgacgtacccgaagccaagtcccgcgcctcgaccaacgccactttgaggccgcgcgtggcagcatccagcgcacacccggaccccactacgccgccaccaatgaccaccacgtcgaactgctcagtgccaaaccgctcccaggccgccgcacgttgctgcggtcccaacgcagaagccggccatgtctgctcgctctccggtgcttggatcagatcagtcacgacaccaggactcctcggttattcgtcggtaagttaaagttaaattagtgtgccaccaaggctagttcgtcagtcgaccaaagatcggccttagtccagatcatcatgtgctgtcagcgtgatgcgcgacctcggtgatcgagccggataacgatgggtgaacggctagtgtttgcgccaactcgttgacggtgatccggttttcaccgccacggcaatcggtaggatcaattcggaggcgatcgacgccaccaccacgccgccgattaccacaccgatagatgggaagcaaaacatcttgacgaacccatgacgcgcctcgaacatcttcgcccacggattggtccgcaacggcagcatgatggtccgggcaaataccaaacagttgtcgaccgccaattacggcatccccaccgctgggatctcgtgcctggtgaaaacctttgtcgcgaaggtgcgtaaccggatcaggctgacgccctcatccaacgcgtggtacatcgcgatccgaccctgcatcgccgtcaccgacgccagcggcaacaggccggtgcagtcctcctgacgcgtaaataccgggcaccgatgtccgcgacacccgatccaccgtcaagtagttgccccgccccaactcgaggccgacccgatccaggtcaagacaaccggtgttgaggaccgacccgatggtcataagggcgtggctaccttcaatggtgcggccgtcgatcatcttcaccaagacaaccggtgtcggtgcgggtaaccgattccgcatgcgcgttcttgaacaaccggacgccacgttcagcgaacgacccttccaagaccaacgctgcgtcggcgtcctcgtacggcaacaacgtggtactggctagccaccaccatcaccaacacacccagttcgatgtaagcgttgacaaactcagcaccggtggtccccttgaacccaccacgatgaagtggtcaggtaacgccgccaagttgtaaaactgccgccaggtcaggatgcgttcgccgtccggctaagccgacagcaggatccgtaggctggcctcggtggcaatcaacacaaagtcggcgtcgtattcatctagtgctcccgtcagcggcggtcactttcgattgtggtgacgaaccaaacccggagttgagtaagccagcctattcctggccagcaagcatgtctacgcccatgttgcgcaactgggcagtaacgtcggccaactgcgccgcggccagcgccctgacgcgggcatgaatgccaggcaacgagaatttggcatcgtcgatgttgaagccaagccattacgctcggtacagctcgctgagcagcccggtggatgcgatgaacgtcctggacggtacgcagtcgcccaagacagccgccccaccgatgccaccggagtcgatcacggttacttgggctttttgcgggcgtgacgtggtcgctgctaccagtgcagccccgtaaccggccggacctcccccgagaatcgcgatctgggtcaccacaacctgtaacctaacttagcgacgatgcactccgcatgcagcgcggaatgaaccggagccgagcccccgcggcccggccaaaccattggttgaacgccaagcgggcgcgtgccgattaagctttccccgtgccgctttatgccgcttacggacctaacatgcatcccgagcagatgctcaagcgtgcaccgcactcaccaatggccgggacaggctggctgcccggatggcgcctgaccttcggtggtgaggatatcggttgggaaggcgcgctggccacggtcgtcgaggacccagattcgcgggttttcgtcgtcctctacgacatgacgccggcggacgagatgaaccttgaccggtgggaaggctccgaattcggcgtccataagaagattcgatgccgagtggagcgcgaatcctccgacaccacgatcgacccggtgcttgcatggctatacgtgctagattcctgggagggcgggctaccgtcggcacggtacctgggcgtcatggccgatgccgccgaaatcgccggggctccaaacgattatgtccacaatcgtcgcacgcgcccaggcccgcaacataggcccagggactacagcctaggaatttcgcgaggcccgtgtctgttcgccgacacgccgtcgtagccggcatttagcggacggatgccgcccgacgtaaccgtaacatcgtctacatcgtctcgagctagcggacaagttcgcccagcctagagcctagatatgacgtactcgaccactaagtgggcaccatcccaccagcacaggccctttagcggccagtacgcgtcgatcctggagcaatgctcccgcccgctgtaccaccagtcgaggccgccgtactcggcggcgacggcggtagttaggaccaggcgaagtcaagtcaccaaatcaagtcctcgatctcgtattgcaggactggccggggcaacccgccatcgagcgtaaccagccgtgcctcgttctccatcgatgactcagcctgcgacaaagccaaacccagcagctagcgtacggtgatgataccccgccgaccagactatcggtcgacagctctataagctctatgtaggtcgacgcgggtgcacgtgtcactgcgcagcgcggcgtcgagcgtcgccagcgcagtgtgcgagcaacctcgatagctgtccaggaaagcgtcgtggccggtcgtcccgcgaacaacatcaacggcgcgccttcgcggcgatgcacaatcagacagtcggccgaacgcaagcaagcagtggccgcagtgattgagcacatgcagatcgggggttccagcggtgtttaagccgtaggcagcggcggcagtgcccaggcacaccgccactgtcgtgccggccgccacgtccaacccgcacagccataatgccgtagtcatttcgccacgactatagacaccacgcaaaaccttcagcagtgcaacacaattgagttgtacctccaagccgctgccggtggagaaatgtcaattcctgggctgaacctaacgactccatcttggacgtcaagtagtcagctgaactctgcgtatatgctgacaatcgtcgggggagtcgccgatgccacaattgacctcgcgaacgtccgtagaatgccaaagatgcggtttgtctttttgcagacacgcgctctcgtggctagaaggacacagcctgctcaaaatgttgaccatcacccgcagtccaatagccaatgccagctcgtcgaggtcaaacgtcggctgatgcagatccaactgcagcccccatccggccacacacccagtcgggccaccgcaccaggaatttcctccaggaatcctcccggccttcggactggcgggtatcgaccagcgcatcagggccaacagcttcaagcatattgtgggtcaggatgggtatcgagatatattcgtccacgacaaggagtgcaccgcactgatactgtaggacgtattcgatcgccaatggcgacagtaacgcggaagcagactggcggctgatcccctcaagattcaacctaggtttgccggctgctggtgtgccatgtaccagttaagacgccggtttggggtatggcgttggcgaccacgcccgcgttgaccacggcttacaccaatacggtgctattgcgcggatcgacgcggaacgacagcactccaggcaacccagtaatgagtgcgccaagcccgtagaccaagtcggcagtgaggtgcgagcgggacgttttccgccaggcgaatacagtgtgatctctatcgagtcggcggccgaggtaatggaaccgtgtcggaccgcgaccttgcccacttagagtcggggctcgcagtgcaaagcgaaaattcgcactcccagtgacgatggcatcgatcagaaccgccgggcatcagctcttcggcaaactggaagatcaatcgcacgccgaccgcgctatttcctgcaccgacaccaaaaccactgcagtaccgagcaggctggcggtgtgcgcatcacagccacaggcgtgcacgacattaggcatcgtcaaggcatacggggcgcgggtacgttccgctaaaggaagcgcgttcatgtcggcacacagcgcgatcctgggctcaggttcaggacacaaatcgcaagtcaagccggtcccacccaggcagcactttggggttcgaccctgcatcggccagcagctcggcgacaaactgtgtggtggcaaactcctagcgacccaactccggatagcggtggatgtggcggcgccacgcgaccaggtcgtcgtagtggggagcttggccaagagtcggctgtgtcgacggggctcaaacttctgcgctgctgcgccgccagcacccagtcacgctcatcaagagtttcggacgaggcaaacagtcgtgtgcgccagcatgaccgcaccgtcgaggactgcgtggtcgccgctgggactggcgggactgcggcaaaggcgcgctgatgaaccgtggctccggcggcgttcacaccgatcaccggtgcatccccggcagcacctgtgtcacgtttccccatagcagtgctgcccagcggaggccgcgtcttgacgtcaggcgccaccgactcgcgtccgagttagcgcacctcctcgcagtacacgtcaggtaaccattagtctggtttcaacttcgcatatgccgccattacagtgtggtcgatttcgtattcacatccacctgctaacacgcccacagcaaagcacgtaaccgttctactctccagctcacacagcgaatccgagttgaccgcccgcatcgcatactacaaccgccgcgtgtccgcgggattacgccgcgtgtccgcgggattacattgatcgcctgccccgccgttagtgaccatgccgggcacaccagttgccctggcgccaactgctgccgcagcaccacaatgaccacctggcgctacgacgaccgcatcagctatgataacccgccaagggcggcgcgacgacggcatgcgattccttgcccaggtattcgatcgtgagctcagacaactccaggaacgggccgtggcgatgtcggtcggtcggccccggatgcaccatcaccgccaccgcgacatcgtcgcacctcctggcctgcaacatgagcactttaaccactgccaacttcctcggtggaagtccccactttaaagccacggtgagacccaggccgccggctaccttaacaagcttaacaagcgctatcgcggtacctaacaccgacgccgcgatcatggatgatggatattgcggccgcaagcatgtcctgtccgatcccggacaacccatcatactcggcgcacaccccgacgggcaggagaccactgcctacagtcgcgcgaaacgccgtgtccagaccacaggtgggcacggtgatcacgaaaccacgttcggctaccagcgcctgcgtcttggcacagctacggcgttaggcgaacgtcagctccagctgagcatgaattgcgtacgacaaatccacaagatcggcaccacgacgccacactccatactcgacgttggtcaaacgctgttactgtgggcacccatgcagtatcgcaccgacctgcagctgctctgaccacaatgatggctcactcgtcactcacgccgttccggcactcatcgtcgctgggctaagctcgccgactgtgacttacaccctgctcgatcccgacgaactcgctcggcgggccgcccaggttattggtgagcgcaccggtatccttaagcacgacgtcgcagtcgtcctcggatcgggatggtcctcggcggttgcagcgctcggctcatcgagagccgtgttcccccaggccgagctgcccgggttcataacgcccaacgcagccgggcataccggcgagttgttgtcggtgcgtattggcgcgcatcgggtgttggtgctggccggtcgcatccatccctacgaggggcatgaccttaggcacgtcgtccatccagtacgcacggcgtgcgcggccggtgcacgcatcatcgttctcactaatgcggccggcggactgcgtgcagacatggcggtcggccaactggtgctgattagtgaccacctgaacctgacgacacgttcgccgctagtcggcacgcacttcgtcgacttaaccaacgcgtacacaacgcggctccgaaaactcgccagcgacaccgacccgacactgaccgaaggcgtgtacgcggcccagcccggcccacactatgagactcccgcggaaatccggatgctgcggatgctgggtgctgacctagtgggcatgtcaacggtgcacgagaccatcgcagcacgggctgcgggcgctgaggtgttgggcgtgtcactggtgacaaacctggcggccgggatcaccggcaagccacttaaccatgctgaggtgcttgccgcggggactgcgtcagcgaaccggatcgggtccctgctggccgacatcatagcccggttttgaaggctgccgtgacacccgaagagtggatcacgcacgatcccgacccacagacagccgccgagctggccgcgtgcgaccccgatgaacttgcggcgcggttcacccgtgcactgcgcttcggcacgtcgggcttgcgcggaccagtgcgcggcggccccgacgccatgaacctagcggtggtgttgcgagcgacctgggccgtggcacaggtgctcctgcaacgagcgggctcgcggcctgcaaccgtaatcgtcgggcgcgactctcggcacggctcggcggcattcgtcgctgcgaccgctgaggtgcttgccgctgaaggtttttccgttctgctgctacccaatccggcacccacgccggtggtggcgtttgcggtgcgcaataccggcgccgcggccgggatccagatcacagcatcgcacaacccgccgaccgataacgggtacaaggtgtatttcgacggcggcatccagatcatctctcccattgaccaccaaatcgaaaacgcgatggccgctgctcccctggccgaccagatcaccaggaaacccgtaaaccccagtgaaaacagcgcctccgatctggttgaccattatattcagcgagcggccgcggtacggcgctccaacggttcagttcgggttgcccttacaccgatgcacggagtgggcggtgcggtagccgtcgagacgctgcggcgcaccggctttgacgacgtgcacaccgtagcggcgcagttcgagcccgaccccgactttccaaccgtcgcgttcccaaacccggaggagcccggcgccaccgacgcattgctggccctggccgcccatgtcggggccgacgtcgcgatagcactggaccccgacgccgaccgctgcgccgttggtatacccaccaactcgggatggcggatgctgtccggagacgaaaccggttggctgctaggcgattacattttgtcgcaaaccgacaagccggaaaccgccgtggtagccagtaccgtggtgtcgtcgcgtatgttgccagcaatcgccacacactacaacgcggtccacgtcgagaccctcaccggcttcaagtggctggcgcgcgccgacgcaaacctgccgggcactcttgtgtacgcctatgaggaagctatcgggcattgtgtcgaccccactgccgtacgcgacaaagacggcatcagcgccgcggtgttagtgtgcgatctggttgccgcactgcacaagcagggccgctcggtgcccgacatgcttgaccaactcgccctacgccacggcgtgcacgacgttacagcaatatcacgtcgcattggccccaaacaaacgggagttgacgaggctgtcgacctgattcagcggctacgcgcagccccgccgagtcagctggccgggttcaccgcgaccactaccgatatcaccgacgcgctaatcttcaccggcggtgatgatgacacgtgggtccgggtagtggtgcggctatcaggaaccgaaccgaagttaaagtgctacttggaagttcgctgctcggtggctggcaacctaccatccacccgacaacgggccagggtgctgcgcgacgagctagtcaccttggtgcagcagtggtgattctcaggtgagtcagcggggcccaaattggcagtcgctggcgtcaccgaaacccggcacaatcacaatatagtgattgcttcgttgagtcccttgtcaacggcggcactgagaataattgtgctttgggaacgttttctctacttccgtaaggcccgccggtgggtccaccacaaagaacacaatgatctctgttgcctggcgcgcagcaacagaccggtggtgtgtggcatcgactcgccaatggccagcattgggtcaagaaccattaccggctggacaattaggtcgtcaagcagcgattccagatacaggaccagctgatgagtcacctcatcactggcaaccgacgaacccaacctggacttcgggtaacgcaacatgaccctcatcgaccatgcccagaccggtgcgcagcaccggaaccagtagcggcggtctggccaaccggacgcttaacatctcagtcaacggcgttaggatcgaaaatgtttcacaaggcgtgtcctgggtagccctgtaaaccagcatcaacgtcaatccacgcaaagccgccgggaacacagcaagccggtgcattcgtcccgcagcaccgccagccgggcggtggccagcgggtggtcgatgacacggacgtccacagggttggacccgtataacaatcggaattagcccagctgacacacttagttgttcgccctaagcaggtcaaccctgaccatatattccccgagtgaatccccgcgaaggctaatgagctgggcattcgagccttccggatgttcggagccatgctggtatgcgggcggatgggctgctcattggtccctcgtgtcggccttgccgcagcaacacttccggccccacacatgttggtaggcgtagtggaagaaaaccactcgcaggacaacgtcatcaggaactaatcgattcccttcctcgactcgctggccgctaacagcgcaatgatggcccaagcattcgcggagacacacccgaacgaaccgaactattcggcgctgttcgacgacgacacgttcggggtgcggaaaaccgatgcacgctcaatggcgatgcctttcccaacctgggttctgcattactcaccgcctgctacacaattcatgggggtcgccaaaaacttgcccgcggccagttccccggtctgtgctgcaggcaagtaccaacgcaagcatgcacctgagtcaacttcagcaatgtaccgacaacgaattcagtgccattctctgcctctccaatagacaactaggccagccctgccgactgtgtcgttcgtcattcccaacgacggcaacaacatgcatagcagctcgatagtggtggccgatgcctggctcaactggccaccctttccgggcacgccaactgggtggtgaccaacaatagcctgttcactatggccttgggacgaggacgacaacaccaagtcacaatcaaatccccattgtgtcctgtgctatggcgcacatgtgcagccggggacatacaacgaacagatcagccactacaatattgcttttcatcctagagcagatgtacaggctacccaaaacgggtcacgccaccagtgctgcggcaatcaccaacatctgggccgggtaatcaccggcgggctgagctacccgtggactagatccggcaccgtctcgagctgccgctatcctgtgccgcatggttgcagacctcgtgcccatctgcctgagcctgcccgctggtgatcgctacaccgtatgggcaccccgttggcgcgacggcggcgatgaatgggaggcgtttctcggcaaggacgacaacctgtatgcctgtgagacagtcgctgacctagtcgcatttgtgcgcaccgactccgacaacgatctggtcgaccaccccgcgtggaaagacctgacttccgttcacgcacacaagctcgatcctagcgaggacaatcagttcgatctggtcgttgtcgaggagttggtcgccgagaagccgaccgccgagtcggtgaccacgctggcagcaacgctggcgatcgtggcgtccatcggttcggtgtgtgagttacccgcagtgtcgaaattcttcaatggcaatcctagcctaggcgcggtgtcaggcggaatcgagcatttcaccggtagagccggccagagacgctggaattcgatcgccgaaatcatcggcgaagctgggatgacgtgctgagcgcgattgacaaggtcatcagcaccccaagggtcaacgctgcgatgtcggccaaagccgccgacgaactagccgaggagcccgtagagccggaggtagagccggatgacgaggatggtgccgatagcgcgaccgctcaggcaaacaactctgacgacaccgaagacgaaagccgtacggcggcgacaccgtcgtgctgggcagcgacaaagacttttggctacaggtgggtatcgacccggtccggatcatgacgggggccggcactttctacacactgcgctgctacctggacgatcatccaattttcctgggccgcaacggtcggatcagcgtattcagctcggagcgggcgctggcccgctacctagcagacgagcacgaccatgacttgtcctatctgagcacctacgacgacatccgtaccgccgccacggacggctcgctggcaatcgacatcaccgacgacaacatctacgttctcagcgggttaagcgacgatctggctgatgggccggacgccgtggaccgtgaccagctggacctggctgtcgagctgctccgcgatatcggccagtactccgaggaaagcgccgtagacacggcgctggaaacgaatcgtccgctgggcaagctggtggcccatgtgttgagtcccagcgcggttgacaagccggtcgccccgtattctgcggcggtacgggaatgggagaagttggaacagttcgtggaatcgcggctacgactcgaataaaggttgcgttctgctgacgcagcgagtctgtcggcggttacccgccggcagacgagaaagttaacctaatgtcacttcctaacatcagaccgctaccgctgtttgagttccaacgaccgggcacgttcctgttcggcttagtgccgctgaccctactcgccgatgtcgtcgtacagtaacgacgcggacgacgcctaagccggttcaccgaagcatcggtaccataggtgccgtgccggcaccttcccatcatggtatagttgctatgcccgaccctgcttaccggtggcgctggctacacccacccacgacatgcatatgccacgcagccgcgccgtcgtcatagtgaccatcgacatgtcatagtcgatacaggctaaccgacgtcaacctcaaacggcttaaagcgaccacacagttcgctagtaggcctgacaccaggcatcatctcgggcctggttggcttcatgggaacgccccacctggttataccccgaccccgcggcactatgcaaccattgacaggttgcagaacttcacagtttgaccacggcactgagaccggtgaggcaatcttgaccacactgcatgcaatcaaagcctcgagcgtaaccggtggagatatcctccgcgcagccttcctggaccatactcctgtcgatggcgggaaaacaagccatcagatcccaaggatctccactacagtggatagactgcggcacgccaagccaaagatcagggggtgaccatctcaactcttgcgttcggaacgcagggcggcatcagcacgctgggccagcaactggtagctagcccaatatcaaccgagcagatagctccgatcgcccggctggcaggaggtaagtcctaaagtgccacaaacatcagcaaactcaattggagctaggacatcatccggggtgagatcggataccgcgcacggtgtcgggtggctgcgcctcaacatcatcacagcaatcatcgctaccgggtgggcgacattgatcaaccggcgacttctgacctgatcgatcaggcagacagcctgcggttgcagaacacgccggccagtaccgcgccaaccatgatgaccgcacccagcaagatccaggctgcgctgcgtcgcgaccacagttgtcatagccaatctgccgctgcagagtcgaatagacctgcttgagcgagtccagatcgtaggcgtggaatacttgaccgtcggtgatctcgcagatcttctgcagggtttgattgaccaccagaaccggaatgacggcgtcgttgtacaacacggagccgtcgcacatgccgaaggagacagtcaataatatatctgccactaccccccagatttattatcgtccgcgccgcggtgaaagttctctgcagggccgttgaggtccaagggctcgttttcggcgccgtccgactccaagacgatccgcgcgatgtagcgggccttcgccgcctcccatcaccgtgccgaccggggctactatgtctgcaacgcggcggagatgcggtcccggttgaggttttcggagcagctcgcaggctgtcgatcgccgccttcacagcgccacagttcgtcgttgaggcaaccagcagggcagcggtagccacaaactccaccagcccaaagttaatagccggcgtcacctcgtcggtgaattgcttatcggcctgctgcgctgcgaccaatcaactcggcgcgacatcggtaacggtcatcgactcttagacatcaatcaccaacatcacgaacgcgcagtcgcagttaagtctaatccaaacattgttatatcagacccgcaatggccgtcgtcagcagtaccaacgacgtggcgaacagaagcgtcagcaggtaccagcaccgaccggagcagcttggcgcgacacgcaccagcacgtccacgtcagcgaatcgcaaaacctaccggcaccgagtgaaccgcagagcaagatacacacccaccactaccaacacgacgaacaagaacaaccatccatgctgaaagcccgtgagcaacatcgatcccaggaagggcaattcaattaatgttcatgcccccaaacctcgtagcttccggttctccaatagcgttctgccccaacgctatccgaccagcacggcgaaccgaggcttgataacctcatcgattattgctaaccgttgatcgaacggaataaacgccgacttcatagcattgatggtgaaacgttcgagatcaccccaaccgtagccgaacgcctccaccaagcggtgcatctccaggctcatcgacgtgtcgctcataagccggttgtcggtgttgactgtcacccggaaacgtgcccaggccagcagatcaaacgggtgctcggtgatgcttgccaccgcgccggtttgcaggttcgagctggggcacagctccagcggtattcgcttgtcccgcaggatcgaggccaggggacccaaccggatgccaccaccaggatcaacgtcgatgtcgtcgacgatccgcaccccgtggcccagccggtcagctccgcagaacgcgatcgcctcgtggatagatggcagcccgaacgcctcacccgcatgaatagtgaagcgcgcattattactacgcatgtactcaaaagcgtcgaggtgccgagtcggagggtgcccagcctcagcaccagcgatgtcgaatccgacgactcctttgtcccggaaccggatcgctagctcggcgatctcccgcgacattgccgcgtgccgcatcgctgtgaccaagcagcgcactgtgatggcattgccctcggcggcacaagccctttcaccgtcagcaaaacccgccagcacgcttgcgaggacctcatcaaacgacaacccctcgtcgatgtgcagctccggagcgaaccggacttcggcgtagaccaccgaatcagcggcgaggtcttccacgcactcataagcgacgcggtgcaacgcctctggtgtctgcatcacggccacggtatgagaaaacggctccaggtagcgctccaacgagccgctgtgcgaagcagtgcgaaaccatgtctctagcgactcaacgtcggtagcggggagcctatcatagccgacctggccggcaatatccaacacggtcgctgggcgcagccaccgtcaaggtggtcatgcagcagggccttcggcgcttgcttgatgttttctaggtgcaatggcgtattcatcgggcgactctatcgatgatcaacgatcacggctccggcggtgtgtcaccaacgctccaaccacgctacagcttttacgccattgctgggccgaggtattctgtagtttcggtaggcgagctgaataacggttcgccgggagcaaccagctcgcactcagaacacagacccacacatatgagacatattccacacacgggtctggatcagcctgttggtaccgtgcacattctcgccacgttaagctcgattacccggctaactactttgatagcggtattgaatgaggtgaggacaacggcgacacccgcgaatccggctacatcgagaccagtagcagcatcatcgcgcagacggcgaccacccacgaccacataccggggagatcccggtatgtggtcgtgggtgctgcatcgtatcagcggcgcgaccattttcttcttcctattcgtccacgtactggacgctgcgatgttgcgagtgaacccgcagacctacaacgcggtgctttctacctacaaggccccgatcgtcggcttcatggagtatggcctggtggccgcggtgggattccacgggttgaacgggatccgggtcatcctgatcgacttctggtctgaaggcccccgccaccagcggttgatgctgtggatcatcagcgtcatcttcttgctgctcttggtcccagccggagtggtaattggcatacacatgtgggaacacttccgaatgtgggagcacttccgatgagcaactccgatcttcagctcagacctcaagttcaacctacatgccaaaaaggccagttagccccggtgcggcagcgcagctacgaccgccccgcaagcttagacaaccctcgttcaccgcgtcgacgcgccggcatccccaacttcgaaaagttcgcctggctgttcatgcggttctcgggtgtcgcgctggtggtactggcgttcgggcacttattcatcatgctgatgtgggacaacggcgtgtaccgcatcgacttcaactttgtggcgcagcgctggtcttcaccgttctggcgattctgggacctggcactactgtggctggcgcaagtccacggcggcaacggcttgcgcaacatcatcgacgactacagccgcaaagaccacacgcggttctggctcaatagcttgctgctgttgtcaatggggttcacgctggtgctgggcagctacgtgctgttgtcattcgatcccaacatctcctgaaagtctgcgaaaggcaagctttgatccagcaacaccgatacgacgtggtgatcgtcggcgcaggcggtgccggaatgcgggcagccgtagaagccggcccccgagtgcgaaccgcggtcttgacgaaactttatccgacccgcagccacaccggtgccgcccaagggggcatgtgcgcggcgctggctaacgtcgaagatgacaactgggaatggcacgccttcgacaccgtcaagggtggcgactaccttgcggaccaggacgcagtggagattatgtgcaaggaagctatcgacgcggtgctcgacctagagaagatggggatgccattcaatcgtacccccgaaggccgcatcgatcagcgccgcttcggcggtcacactcgcgaccacggcaaagcgccggtccgcagggcctgctacgcggccgaccgcaccggccacatgatcctgcagacgctctaccagaactgcgtcaagcacgacgtggagttcttcaacgagttctacgcactcgacttggtcctgacccaaaccccgagcggcccagttaccaccggggtagtggcctacgagttggcgaccggcgatattcacgtcttccacaccaaggccgtcgtgatcgcgaccggcggttcgggccgaatgtacaagaccacctccaatgcgcacacgctgacaggagacggcatcgggattgtgttccgtaagggacttcctttggaggacatggagtttcatcagtttcacccgacaggcctggcagggctgggcatcctaatatccgaggcggtgcgcggcgaaggcggacggctgctcaacggcgagaacgaacggttcatggagcactatgccccgacaatcgtcgacctggctccgcgtgacatcgtggcccgctcaatggtgctcgaggtcctggagggccgcggcgctggcccgcataaggactacgtctacatcgatgtccgtcacctcggcgaggaggtgctagaatccaaacttcccgatatcaccgaattctcccgcacctatttgggtgtggacccggtccacgagctggtcccagtctatccgacctgccattacgtgatgggcgggatcccgaccaccgtgaccgggcaggtgctgcgggacaatacctcgaccgtccccggcctgtacgcggccggcgaatgcgcatgtgtgtccgtgcacggcgccaaccggctgggcaccaactcgctgctagacatcaacgtcttcggtcgccggtccggcatcgcagcggccagttatgcttcagccaacgacttcgtcgatatgccaccgaacccagcggagatggtcatcagctgggtagctaacatcttatccgagcacggcaacgagcgcgtcgccgatattcgtggcgcgctacaacagacgatggacaacaatgcggcggtgtttcgtaccgaagaaacactcaagcaagcgctcaccgatattcattcgctcaaggagcgatactcccgaataaccgtgcacgacaagggaaaaagtttcaacagcgacttgttggaagccatcgagctgggctttttgctggaactggctgaagtcacggtggttggcgcgctgaaccgcaaggaatcccgtggcgggcatgcccgcgaagactatccgcaccgggatgacaccaactacatgcgccacaccatggcgtacaagcaaggcaccgatctgctcagcgatatcgcgctggatttcaaacccgtcgtgcagactcgctacgagccccaagaacggaagtactgatggccgttgaacctgtcgaggtcaagtcgctcgaacctccccgaccgccgatttcggatgacgcggtgatggtgaccgtgaagatcgcacgattcaacccagacaaccccgatgcatttgcggaaaccggtggctggcagagcttccgggtgccctgcctgcccaccgaccggctgctaaacctgctgatctacatcaagggttacctggacggcacactcaccttccggagatcctgcgcgcacggggtgtgcggctctgatgctatgcgggttaacggcgtcaaccggctggcctgcaaggtactgatgcgcgacctactaccaaaaaaagcgggcaagaacctgaccatcacagtcgaaccgatccgcgggctgccggtggaaaaggacctggtggtcgacatggaaccattcttcgacgcctaccgcgcggtgaaaccctacctgattaccagcggcaacccgccgacccgagagcgcatccaaagcccgaccgaccgcgctcgctacgacgacaccaccaaatgtatcctgtgcgcatgctgcaccaccagctgcccggtgttctggagcgagggcacctactacggtcccgctgcgatcgtcaacgcgcatcgcttcattttcgacagccgcgatgagggtgccggcgaacgcctgaccctcctcaacgaggtcgacggagtatggcggtgccgaaccacgttcaactgcaccgaatcctgcccacgcaacatagaggtgaccaaagcgatccaagaagtcaagcgcgcgctaatgttctcgcgctaaccgcgctggtgcttggcagcccttgcagcaacattcaccccccaggagtaccgtgccgcgaccgccagacgatccactgatgcgatatcgcatttcgaaagtcacctgtcattctgacaaattaaggctgagccatttggcacccataacgtgctgtcaccaagcccatccgtccaccccgggcgagaaggtagtgtgacatccccgaaaggatggggccacgtcgtgctgttgtcagcagaccacacgcaagagaaaaccaagctgtttctgtattaacggattcttggccggatgtttggctgttgggatggcatagttcgtaaatccgtagcggtcggcgcacaggtgttgggccattccgtgtgacggtaactaggtaaatctcgggcagctgcaacacctcctctggagtcataccgtttactgtgttgttgggagatcttttcggctgcactgtggcgatcgccagtggacactacagcgtgaaccaaagcgtaccgttcaagttgatcggcacagtcaccgacgcacttgcggacgtatgaaatgcagtcatcgatttcagcggaagtggcgagtcacatcatccctgggacctggccatgaacttggtagatgcgggccaggctaacgacgctggcatgctcggcggcgagctgcagcatccggctgccggtgccgctgattatcagcggcaccggcggtccgtagccgttgaagccacggcattggatctgccaaagcacgggaatattttatgccgttcgcatttcagtctgttgcggatagccgtaagggctgaaccgactggtgaattcatcgatagtttagcgtagccgtcgcgccagggcaacgaacatgtctaaggtgatgttgtcctcaacatattcccatttcatattttcgctgaccagaacaacatccagacgactgttgatcataactccggttttggagatatctcattccagaagaacagttttcaagaacccaatgtcgaacaccaggacgccgactcgcagacacttagtcacggccggccaccagcgcggaaagcggcgacggaactccaagacgatcagtgacgaaaacggtttcatagatatacttttcggaagatggacaggtaaagatgaagctcttaagtacctcgacagcgaacacgttgaaatagaaacaaaagctgtcatctgagtcattgttcatttgacaaatggagcgaacgtgccatcacattattgccttcggaccatgttatctaactctttttacagttatcgcgttgacgaggtcacatcttggcttcctgtctcgtctcatgggtatgacacaaaaaatcgcatcgagccgttattcctgaaagacgcaaaatttgttatccgactgatgtaccgtatcgttaaacaacgctccggcgaggagcccgaatctttcgccgtccatacgcaccatcccaacctagcccctgaccggcgacatccatgaaaaatttctagaacgtgcatagcgcgccaccagccagtgttcataagttggccatgtactagaccacccggcccgtaggctgcttatggtgtatcgacttcagcgctatgctgcagtacctggatggcctgaatgtcaagagattgaaggacggacaactatgcatgcaacgtctgcgtatttccccgacaacgaacgcgcttccatcgcaataaccaacgacccgcgctcaattacctacgagcaagtcgccgaactgcgctcccgctcagcaaagctgacgtgatcgaactaagctaccataccggcatcgagagcatgctggcacacatcaacaccgagctggccgtcaccgaatgtaggtattcaattccattgaaaaggattgaattccgttgattaccccgcaacgtatagccgataaacctatcgatgttagccatatacaatatggcgcagtcccttccgtctttcaccgtcatcgcggtgatccgcggggccatctcccgatagccatcgatgccggagtaaccttcggtgtaggcgcccagatcaccgttgaccagtgccagctaattgatggtaacgaacaccggccttagtggcgggctagggcaaacatggaccgtgccaccttgtccgttccgctgataacgtgaatttctttgttcaccttgctgtttgaatcgtcgttaaagacaatatcgggattaaacaacaacaccacggcttccaggtcaccattggccattgcggccatcagctggctgatcaccttgctgtggctgggatcgggtttggggcgactccgcggtaacagctttacgggccagcggcagcgtagcggccacgctggtcccgaacacatctgccacatcggctaaccgtacagcgcaccagtcatgcagcacgaacgctacccactgaccgaggctgaggcgttctagtacaatcattgccacaagccaagcacactcggcggccaccacggtagacagcagatcgacactgtccaaaccgacgaccacgggttcgtggcagctagttaccagtgtagccgctcacgcagtgagtcgccgcccccagtcgatctaggccaagcttgacttaccaccacgatcaaccagctttgaggtcctcatttaccggccacagctccggtcagccggtaaatgactgacataggattcagccgcagttccttctggcaagccaggacactggggttctttccactgtggggatacgccacaccgcttgcgatcgaattcgccgaacatctagcccactatgctctccgggcgacttaaacagagtgttcttcatcagccggcggcaccaaaacggtcgcaaccgcgtagaaacttgccaatcagtacttcaggctcaacagcaaacccgacaaacataaggccatttcgtgctctatcgcctaccatgcgccacccaaggcgcactagcgattaccggactaccatttttcaaagcgccgttcgagccggtgacgttcggcggcttccggggtgtcaacacaagcccgagctgctccatacccgacatcaaggccttcgtgcagtgggctgctgaccggacaaccgaggtgaatcaagttcgaaggaccccagaccgttgccgcgatcttcttggaaccggtgcggaacgcaggtgattccattaccacctcctcccttggctattttgagcgggtccgcgagatctgcgacgaatacgacgtactacttgtcttcaacaaggttatctgtgcgttcggccggactgggtctatgttcacctgtgacgacttcggctaccagcccggcatgataaaacccgcgccaccaggctgacgttgggctattcactgctgggcgcgataatcgccagtgaccgtcgtgttcaaacttttcaacgatggcaagacgttgtttccgcacggctatacgctcggcgatcacccgatatcgacagtcgtcgcgctggccaacctcgacgtcttcaagcgcgagaacctcaactagccggtaaagcagcactcacccgcgttgtgcgccaccctggagaaattgcatgacctgccgatcgtaggcgatgtccgcggcgagggttatttcttcagcatagaactagtcaaagaccaggcgaccaagcagaccttctctgacgagtaacgccgagagctgctgggtaccgtttcgtcggcgctctttgcggccgggctgtatggtcacaccgacgaccgcggcgattccgtcatccagctggcgccgccgttgatcagttgatcaggccaagttgtggacaccatcgaatccatcttcctgtgcggcatgctcaccgaggcctgcacgcggctgcaggcgcacgcgataatccgataatcgttgaaagctacgatgtgccggtcgacataagtcgacataatcagcgccgtgttccaggaggagatttgggaccccaacgtggcacagcggtatgacaccccagataccgagatggtttgcacccgaggtacaagagccgacaattgagtatctcatcgagatcgcgtcaggtggccgggagttaaaattcgctatagacactggccgagtggctatcccgctaagcgggtgtggtgtgtccgtcaccggcatcgcacttatcccatgcgataaccgcccagttccgcgaaaaggccgctgaaacaaattcccgtcgtcgcggacaacatgaccaccaccgtggctggcaggctaatatagcatttcctaatattcgcctacaacacaatctccaacccacttccccaagaaaccgagcgggacttctgcttccacaatgcaacacactataactcgcccccagcgagcgcttcgtaatcgagttgttgtgccaaagctacgcacactcccgctcggacagcaggaagcgatgtttgattgcgagcccgactaaatcaacctggatacctaatgacgtcctaacaccagaggtctgtctcacatgactttcgtttcggcaatggcaaaacaggctcacctgttgcgcagtccgcgctatgaatcatagcaccagccgaacttgacctcatggctcaactctccggattccaattagtttagagtcggcacgcggactggtcggataccgcgtttaccgcgaaagcccgttcgcacgttgtccgtatatcgcctgccaaggtgagttagcacactttgcaacttctgtaccatcaatcacagcgtggcttacgctaactagacgcccgatcgcctactctgcacacacgatgtcttttttacgttccaccgcatgcctggcagcagcagttttcgcgatcgttggaccagtcgcgctggacctgcctaccgccgtgccagtcggacatgccgaaccgaatgccggacccaacgccggtccagcaacatgcccataccaggtgtccactccaccagcggtggactcgtcggaagtcccccaaaccggtaacccaccgatgccgctggcagtgccgcccaaaccggtcggcggcgcggcactgaacagctgcggaatcgtcaccgctccagacacgccgccagtaccaggtgacctctccgccgaggcgtggctggtggcggatctgaacagcggcgccgtcatcgctgcccgcgatccacacggccgacaccgcccggccagcatcattaaagtgctgttagccatggcgtccatcaacacgctcaaccttaacaaatcggtcgccggaactgccgaggacgccgccgccgagggcaccaaggtcggcgtccacgacggcggcacatacactatcaaccaactactgcacgggttgttgatgcagtcgggcaatgacgccgcgcactcgttggccatgcagctcggcggtatgcagcaagcgctgcagaagatcaacgtgctggccgccaaactcggcggccaggatactcgggtagcaacgccatcggggctggacgggccgggcatgagcacgtcggcctacgacatcggcttgttctaccggtacgcctggcagaacccctcgttcagcaacatcgtcgctacccggaccttcaatttccccggtcccggcgaccatcccggctaccagctggaaaacgacaaccagttgctctaccaatatccgggtgcgttgggcggcaagaccggctacaccgacgacgctggccaaacgtttgtgggcgccgccaaccgtaatggtcgacggctgatggcggtgctgctacacgggacccggcagccgattgcgccgtgggaacaagcagcgcacttgttggactatggctttagcaccgcagtcggaacccagataggcacactgatcgaacccgaccccacggtggccggtaacgcagatcggcacggccatggcctacaagccgccggaatcatgtcatcaaacgacacgcttccggtacgaataggcgtagcggtcgtcggtacgttgatcgtgttcggcttaatcatgatcacgcgttcgctaaaccgccggccacaacactgaacaggcctgaacaatctggatttcattcacaacattttggttgtggtggcgtctctgccgtgatgaagacccttaaccaggacgtttccctggttctcgatgtgtcttaccttcgaacgctccgaccgtgtccttgagttgcgcaacgaccgggtgtcggtcagctgattcgcccttagcagtacagactaatggttgggctcaccgttgtccagcgtcgacatcatctaagactaggtcctttccggcatctaagactaggtcctttccggcatcgccggcagcgctgatgttcatcactgatcaattcgtccttaccacaaggcaacaaaaactgctgacgacgatcgacggtgctcggccagatcgccaaagcgttcagcgccagcgtactcaccaatgcaatcggacgtcagaagtcgatagtgctgatccccgtaggctatatggtcttcgcactcctgggtgcacgctcggtctcgtcgcctatgctattggctggccccaccatcagcatgaccgtggtgatcgtaccggtgtacctcggggaatcctcaccggtcgcggtgcgcggatcgtggctgaccacctattaagtggcgatcgtcagcggtaccatctcggctatctgaccaattacctgctggttggtacgcacagttggcaatggattctggggttcaactgtggtggccgcggcgctgttgctgtcgataattggcgcgcatgccatgcactgcgcgctggtgccaactgaatgtccgggtcttcgacgccgccgggcgctgcagcaaagtggagctcgaaaaccgcgtcggaccgagcttgccgagatcacccatgtcctcagcgaagacaatggtagcgtagccccatgctgtggtggtcgtatcggtgggccaccattttcgtgatcaccctgggctttctcgcccagactaccggcattaaattggtcgtctactacagctctcagctgtttgcggccatgggctttcagaacaacatcgctctgctgacgttgccggctctggtgtagttagccggcgttgcggcggtgtgtaccgtgctggtttttggtcgcctggagaggtcagcgccagattctgttagccggcatcgcagccataagcaccgacgacgtcgtgttgattgctttgttcacccaaggattcagcggtgctaggccgttataagaattcggcaacgtgctgttgttcagcatagactttagcttcgggttcggcttgctagtgtgagtgtaagctggccaagcatgcccgactctgctgcagtcgatggggtcaaacgccatgctaacttcccttccaatctggtgaccaacgcgatcgtcgccataagcttaccgactatacctcattcactaagtgtcacagaagctttagcagtgtttaggctatttgcttcgattgctttcactgttgtttatcggtacacgccagagaccaaagttcgccaacccgaggggctctaacacttctgggaaacgggcaagctctggtttgaagaaacatctactgtcgctaatagtcgattatgaccgctccaggtcagcgctgagatagaccggatctcctcttccgcaaatcgattcacgttttttattgcttgttgtagcagtgactacgcagcacaaaagcccaatacctcaccgaaatcatccccaggttgccggcctggtgtccccgtcaacgacaataataacgggatccgcacgaaaccgcacaacatgctctaaccggtctggcggctcaccggacctgatgcgatccgtcgagatggcccgtcagctagggcacattgaacctgaccatgaccaacaacccgaactccgacgtggcggctgccgccgaaatccacgtaaacgtgctcgccaggacggagcgttcggttgcagcaaccaagtcatacaccgccgaactgctaacattgtatttactgttcggtcagctaagtggttccgacggtgcacacccgacccagctgccgaaactgggtgaacacatgctggcgtacgatgtcgtccccttcgcccagcactaacggttcactcaacggttgatcatcaccggacatggctactcctatcctacagcctgcgaaacagcactcaacctgatgtagacgtgctacctttcttttcaggctttttcgagtgacaacttgctgcacagtgcgcttgccacagtggacacccaggtgactggtgttagccatcgtcctcgaaggcaccagcggccgagcaatactgccgacgttgtctcgcttgacagaacgtggggccgacattttcgtgatcggcactggccccacgcctgggcacttggcaggtcggatcgcgttgcccagcaggcaacccgatgaactgtcgccggtgctgaaaatctttccgtcgcagaagctagcacttcacctggctattgcccacagttaagagcccgatagtccgctcgggctgcacaaggtgacacggaccctgtgatcgtgatcagtgccggaacagtggccatcgacgaacaaatctgccgaccaaactggctacagacagccggctggcagatcttggcctgcggtaccgacacatctcttctgtctgaagacagtattttcccaattaattgtaattaatggttttatcaacgtgaatgtgcacttccgctgcagatcgtacgtagacggaaaacgccatgggtggctatgaactccgaatttcaactgctgcaatatattacgatgactctggccaatttgctcaacgacatgcctgcagaattcgccggctcggtatgagaattcgtctaggcaacgcgccggggcattgcggcaaaaattcacctggagagaacgtggttgagcacggcacagtgcatagcacacgacagcacgcagttacgttacccggataacactggaaatctaagccatacgcaccaccggtgctgaagcgacccgtatggtcacactggcacccgagctgcgtggaaacgatcaactacgcagcactttcgtgacacaggtgttgttgtcgccgtgggacatacgtatgaatcacatacgcaggcaacccaagccgtcaccctgagagcgaccgtcggaaaccatctacgcgataccgccaccgcaccagcgcgcacccggacccgcgctagctttaatggccgacccgcgcgtcactgtcgagttcatcaccgacggaacacatgtgcacccccagcgcagtgcacgccgtgattcatgctgcgggtcctaaccgggtcaccgtggtattcgatgcaatcaccgcgtccagctgtgactacggaacgtttctgcttggtgcggtttagatcgaagtagttgtccaatgtggttcgcgttcagaaaacttcgctgtattgccagcagcactcctgccgtggatagggtaaacccttctgcagagttgtccaaaccggctcagcatcggttcaggactttgatgcggagctggccgccgcagttcagatgaccgcggcggcaccagcccgggctctcggattcgacagcgtggacagccttagggcagatctgtacttcaatcttgttgtactagaacatgatttgcagataacgtccgtcatggctcatggcaactgggcagacagccggcccggtccacacctggcctccgtcacagtaaccggggatcgggtgatcagcgggatagtcggaaaataacagcgcaacaacggctcccacggccatcgtggtcagcgcctaacgtgtgctaggacccgctttcgtctctacccgggaaaagatatgaccacgggagctgaacgctgacaggcttcatgcacaactccgctgtcgctgcccaggaggctgcgaacaaaaccaaatacgctgtgaaataggagaacaccataacaccaagcaccggaccaaacacgctgcctgccgggctgcgtagcactatctgcaggtagatcgaccccacttgcttgaaaagttcgaaccctacggcagctatcaacccgccacgcatcgaggcaaccaaattgacagacttccgcggtaaccaggcaatcatccaagtaaacaacaaccaggacaccagcgttgacaccaagaccgacgcaccctgaaaaatcacaccgaacacaaaaaagtgagttattccaatacatctcagtatagcggccatcggtgcctgatggctcagcacggtgagcgctagggtggtcaagaataccacgaatgttcccaccatcgccaagagatcagacagtttgttgcgtagcaagctcgatggatcgatatggtgctcccaccacattttggtcaacgccgcacggaaatgcgacatccagcacagaccagcccacgccgcggtagccaggccaacgacaccgacggacgcgcgtgcatcgatcgcccgattcatcaagtcgaccagctcctgtcccagctgactagataccgcagaccgaatgtggtcatcgatcgtggtcaataactccggacgacgaaacagcactaatcccaccaccgagaaacttaccatcaacataggaaacagcgcgaagatagtgtagtaggtgagaccggccgcgaaaaagctgccgttgcgctcgtcgaagcgctggtgtgcgcgcacaacatggtcgagccatctgaaccggccccgcagccgatcaataatccccgtgttggccggttccgtcatggcgataagccttacccccgttgcggaagaaagcccagccggtcgtaaacccgctgcatcgtcttgccagccacatcttgagcacgctgcgctccgaccgcaagaacaacctccaattcggttagatcggccatcaattcgtcgacccggtccttgatcgggctgacgaactcgaccacggcctcggcggtgtctttcttcaggtcgccataaccgtgcccaacgtagcgctgcacaagggtatcgacatcaaccccggtgaccgcggactggatgttcaacaagttcgacacacccggcttgacctccggatcataccggatctcccgttcactgtcggtcaccgctgctcgaattttcttgacggacaacgccggatcgtcgagcaggttgatcaacccagcatcactggacgccgatttactcattttcgacgttgggtcggccaaatcgtagatcttggcagccatcttgggaatgaacatgtcgggaaccacaaaggtgtccgggaagcggctattgaaccgctgcgccaagtcacgcgcaagctccaagtgctgccgctgatcctcccccacgggcaccagatcagtatcgtaggccaacacgtcggcagcctgcaacacaggataggtgaacaggccgacggtggtggagtcggcaccctgacgcagcgccttgtccttgaactgtgtcatccgagacgcctgtccgaagccggtaaagcagcccagcacccacgccaactgcgtgtgggctggtacatggctttgcacgaaaacgacggcgcgccccggatcgatgcccaaggccaggtattgcgcggcagtgaccagggtccgacgccacagtgtctcgggatcttgcgcgatggttatggcgtgcaggtcaaccacacaaaagaacgcttcgtattcgtccggatgatcgtactgcagcgcaacccactgggtgatggcacccaacgcgttaccgaggtgaagcgaatcagaagtgggctgcacgccggagaaaatcctgctgaatccggtagcggtactcataatgccccgatcttttcacgtgagccttttcatccgtgccggcctgccaacaccagcgacaccggccagtggtagcttgcggtacccggggtaccacctttagagtcggcagcatgcgccagccgattcaccttggttctggagagccggtcctcctgctacacccgttcatgatgtcccagacggtgtgggagattgtggccccacagttggccaacaccgaacgatacgaggtattcgctccgacgatggccgcccaccacggtggaccgtccgcgagcagttggatgatgagcgtttcgactctggccgaccatgttgagcagcaactggacgaactgggctgggataccgcccacctggtcggcaactcgctcggtgggtgggtcgtcttcgagctcgagcggcgtgggcgggcacgtagcgtcaccggtatcgccccggcgggcggttggacacgctggagcctggctaagttcgaagtgatcgccaagttcgtcgctgggatgccattggtggcggtggcccgcgggctcggttcgcgggcgttatccctaccgttcagccaccggttagccagcctgccgctgaccggatcgccggcagggctgagcgaacaccaattgcgcaacatcgtagaggatgccgggcactgcccagcttacttcctgctgctgatcaagacgttgctacagcctgggctacgagaattggcggatatcactgtgcccgttctgttggtgctctgtgagaaggaccgcgtgctcccgccgcccaaatacagccgtcatttcaccgaccacctgcccgaaagaacccaggtcaccaagttcgatggcatggggcacgttccgatgttcgaagcgcccgaggtaatcaccaagctcatcaccaacttcatcaaccaatgcagcaagccggccgaggccgctagcccagcgagttagccgagcgccttcttcagattgtcggcgattgaattgagaaattcctcgctgttttgccagtcttgttcagaaccgattgagggaggccaagttcttggtaatcttccccgctctcgatcgtgccgatgacaacactcttccagcttctgggtgaagtcaaccacttccgaagtgccgtccagcttgccgcgatgctgcagtccgcacgtccaagctaagatcgaggtgatcggatttgtcgaggtcggcttgatactgtcgaaaatgccgggtgacggtgtcgtgcacagcctcgcccgccttaccgtcagccgtcatcagtcctagcgaatcgtagctttgcgcgacgatgtctgtattgcatgtcgccgtcatacttcttgcagacccacacgtagccgcccacccactcgaggcaggctgctagcatctcgtctataagccaacgcccgtagatcagcccggcggcttcgaactcgtccttgaattcctcgtcttagactgcgacggaacgtgtcttttaacatgccgtcgcagaccttgaaaatggtattcttagtcaacaggtacaccagccacttagcgttcaagccataagaaaacgacgtgcacgaaatcgcggatggaatccttgaagttgtagcgccttgcacgacaccaccatcggaggggatcgacaccatacttgatacttgtgcacgatcggctcgttgccttcggatgaagtgaaagtgattgagaaggagccggactggctaattttgaagttgattgtccgatactgatcaccaaaaattttggtttaccatgacaatctttttggcccaactcaaaaccagtagcgatacattagcgattacaagcggttcgcgaaaaatatttccgatcaaaatatttcgaatagtccctttgggcaacattcacatctccttcagatcgcattcctggaaaggggcctcgtcaggggtggccatgacacacttaacatccacaccgtgcttcttaatggcatggtcggtgtcgatcgttatctggtcgtcaatgcaatcgcgatgctcgatgtccagttcgtaatagtccaggttgatatccagatgcaacaggatcaaacatgtcctttgataagtttccagactacgcagatcatctcatcaccaccgagcttcgactaccgggccttcgactttgatcttgggttcattggacattagagtctaaaaccctccgcccgtgtcaactattgcctgtcaagcaagccccactaacagccttgatgggctagtagggtcgctaaacggccagctaaagctgtcagagttgacgtcgggtcgggtggccacgcgataggctgcaacgcggtcatgagcgccagcgtcaagccccgacttgctggccggcaaccctccaaccgcgttggagtgccccggtgatgaccaggttgagtagccagaaccggctacgcggcaagcgcgagtccgccgtgacgggccctcttagcaaacagggaaacgtgatatgcggctatgtgtatcgctgctagcaaccagcgttggttgacgtcattagcgatgacgtcctagcctgagtaccccaattacacgattagcccacttccgagcagaaggcagcccaagtgagctctgaaaaacagcccccgagccgagtcgatccgcattgggcattcgcaactaaacagattgatgttaggcagagccccggctcggccaccaacgcccgtgcgctgccaagccaacaaaccacctcctacacgttcaccgacaccgcacatgccgccgcgctcgagggcggcgtggccacactgttccttgcatccgggcaggccacagaaacattcgccaccttgaactggccggagtcggagatcacatcgtgtccgcccacggctctacagcgaaacctgtaatttgctccactatatcgctggccaagatcagaatctaggtcctctgcgtagaggatcccgaccatctggattcgtgataggcagcggtctaaccgagccgaaagcgttctttggcaagatcatctccaaccgcagatcgacctgctggatactcccgatgtcgtcgagatccctcacgccaacggggctatcgctgaccgtcgacaacaccatcgtgacgccctatctcatccagctattcaccccagggcacaaacatcgtgatgcactcggcgaccaaatatcttaaatgggcctggcgccgcgatcgccagagtgatagtcgacagcggtaccttgggttggacacaagaccatttccccaaattcatcacacccgatcccaattaccatagggtggtgtatcctgagctcaggacactggcgtatacactcaaggtgcgcatacagttgttgcgttactacaaatccgtggcttttcaccttatcaacgcattcttggtggccgaaggtctcgagacgctgagtctgcgggtgaaatggcacgtcgtgaatgtgcagcggatcgtcaagtttttggcttaccaccgaaacaacaaccaaggcgtggtgttcgtgaactatgcgggactgcccagttcgccatggcatgaacgggcaaaaaagctggcgcaaaggaaccggagctattctgtcgttcgagctggccggttgcacagagtctggcaagacgtttgtgaacgcgctgaaactgcacagtcacgtcgtctacatcggcgacgtgcgctcgctggtgattcatccggcttcaaccacccccgaccagctgacaccggaagagcaactgtccaccgacgtcagcctgggcttggtaaggatcgccgtaagcctcgaaaacatcgacgacatcctgaccgacctgatgttcggcttcacgacgacttgccaaagcaatgatccgcagctatagcagccttttgagggctcctgacatgacaatctccaaggtccctacccagaatgctgccggccgacgaggtcggcttgtcgacatcggctcacttaccaccgaaagcggtgccgtcatcgacgatgtctgcatcgccgttcagcgctggggggaattgtcgcccacgcgagacaacgtagtgatggtactgcatgcactcaccggtgactcgcacatcaccgggcccgccggaccgggacatcccacacccggctggtgggactggatagctggaccgggtgcaccaatcgacaa

SEQ ID NO: 133 - DNA (genomic), 39195 bp, MYCOBACTERIUM LEPRAE; double-stranded, circular
  hypothetical: NO
  anti-sense: NO
ttatcgggtaaagccgcgcccggccagtaaccagtaacttgtccgtttagacttcaaggtgtcgtcgtgatggtcatttggtggttattttttgctggtttggtttgggtggtgttgtggtgggctggtggggtgtgggtggttgatctgcgctagaaggttgccgtatgtgccgccgacggccggatcatcgatgcactgttcactaacacgatactgctgcacccggcggcatgcctgcttgctggctgagggccggtcaacaagccgccgacaccgataccagcggcagaaatggtgcaagggataacatcaggtgcgaatagttataccgtgcacggggacgtgcctgttcaggtgcggccacattgaccacgccgacacctcaaggccatgacatgcacactaaaacgcccctaccccgcggcgctaacaactatcctcacactcacgcctgcatcgatatcgccttcagcacagcccaggtgcccagcccctggcatcatcaacatgtagaccaagcagcacccaccaccgacatgcttacgtgcgccgcgctaatcgtgtccactgcggcaaagcacacgaagcctcatcgaaagcaggcagtcagccacccaccaacaaaaaccccgcaacaccttaatgcgcagcagcaccccacgagcggccaaagccaacacttacttccagcggcacgtccaaggggtaggcactgcccatctgctcgcgcaccatggcctcgatctgctcgcgctcaccgatcgcgacttcgaacagcaattcatcgtgtacctgtagcagcattcgcgacgccagcttcgcctgtttgagcgacttgtcaaccgcgatcattgccaccttaatgatgtcggccgcactgccctggatcggcgcgttgagcgctgcccgctctgccgcctcccgtatctggcgattactgctgtctagctcgggcaggtaacgtcgacggcctaacaccgtcgaggtgtatccatccttgcgtgcctgctcgacgacatccatcaggtagtcgcgcaccccgccgaatcgagcgaagtattgctccatctgcagcttcgcctcctcagtggaaattttcagctgcgtagctaacccgtatgcgcttagcccgtaggccagcccgtaggacatcgccttgacccggcgccgcaattcgggggtgatatcctcgataggtataccgaatgcccgcgaggccacaaacgagtgcaggtcttccccagtgtggaaggcctcgatgagcccctcatcccgggataggtgtgccatgatccgcatctcgatttggctgtaatcggcggtcatcagttcggtgtagccgttattttccgaaccaacgacgaaagcgtcccggatctgccggccggcattggtgcggattggaatgttctgcaggttgggttctgtcgaggacagtcgaccggtcgtcgcaatcgtctggttgaatgtggtatgaatccggccatctgcggcgaccgcgttcagcaacccgtcgacggtgactttgagtcgggtgacgtcccggtgagtgagcagatgctgcagaaatgggtgctccgttttgcagaacagggactgcaaagcatcggcgtcagtagtgtagccggtcttggtccttttggtcttcggcatgcctagttcttcgaacaacacgacctgcagttgcttgggtgagctcagattgatctgcttgccgattacggcgtaggcggcctcagcggcgtctcggatctgatcgccgaattggctctgcaactcggtgagcaaccgcaaatcggccgcaatacccgctttctccatgtcagccagcacctgttggaccggcagctccatctcacctagtagtgaggtagaatcgatgagatccagctcagcgtccaacgcagcggcgaggtctaccaccgcccgggcccgcagtatcagagtctggatggcttgcttgtccacttcgtcgacgttgtcaagcaacgaaaactgttcctgctcaggtgtttctgctcgcagctcgcgacgcaggtaacggagtgagagatcgtcaagagtgaagctgcgttgccccggcctcaccaagtaggccgccaacgcggtatcggacgtgatgccgcctagcgtccaaccgcgaccagcgagatcatgcatggccagcttcgcctcatgcagcgctttggggttgtcgggatcggccaaccaagccgccagcgcgtcgtcgtcgtcgggagtcaacatcgcggtgtcgatgtagccgccgttaccgttcggcggcggctacagctagcgcagtggcgtctccgccgtgcggcagatgtgtaccgacgatcgctagcccagacctgcgtccgtcatcggcgtgcttagccagccaccgcccgaccgtgccggactccagcaaaccgccgcggacgtcaaacccctcgtcgacttcgggtacacgctctccagcggcggccaaagcctcaaacaaccggtcacgtaacacccggaactctaggttgtcgaagagccggtgaattcggtcgcgatcccacggctgcagccgcagcgtgtccgaggtttgcaccaacggcacatctttgacaagctctgtgagctctcggttgcgcaccacgctggctagatgcgtccgcaacgcttcgcccaccttgccgcggaccgactcgacattgtcgaccagcccttgtagcgaaccgtaatcgacgatccacttggcggcggtcttttcccccacgccgggaataccgggcagattgtcgctgggatcgccacgtagcgccgctaagtcggggtactgcgccggcgtcaccccgtacttctcgataacagcctctggtgtgaagcgggtgagttcgctaacgcctttacgaggatagagcaccgtcacgtcgttgctgaccagctgaagtgcgtcgcggtcaccggtgaccaccagcacacggtaaccctcgttttcggcttgagtagccaacgtcgcgatgaggtcgtcagcctcgaatccagcctcagcgaacaccgtgatacccagcgcacctaagacttccttagtgatgtcgatctggccgtggaactcagcggggattgatgaccgattagccttgtatcccgcatagcactcggagcgaaacgttttccgcgatacatcgaacgccgcagcgatatgcgttggagcctcctcacgcagcaagttgatcagcatggcggtgaagccgtacaccgcgttggtggtgaggccaccgcgggtcttgaaattctctgttggcagtgcgtaaaatgcgcgaaatgccagcgaattgccgtccagcagcatcagcattggcttggtgtggtcttcgcagacttcagcggtcattgctgcactcacggctcatactctagggtctcgtgtttgtgtctgtggcggtgagttgttcggttggtttcataggtggtgggtgaaatggctgtttttgcgttttatgactggccgatatgttcggtagtcgtggggggcagcccggaatcctgttgacgtgttttgctgtgttgcggggtttttgttggtgggtggctgactgcctgctttcgatgaggcttcgtgtgctttgccgcagtggacacgattagcgcggcgcacgtaagcatgtcggtggtgggtgctgcttggtctacatgttgatgatgccaggggctgggcacctgggctgtgctgaaggcgatatcgatgcaggcgtgagtgtgaggatagttgttagcgccgcggggtaggggcgttttagtgtgcatgtcatggccttgaggtgtcggcgtggtcaatgtggccgcacctgaacaggcacgtccccgtgcacggtataactattcgcacctgatgttatcccttgcaccatttctgccgctggtatcggtgtcggcggcttgttgaccggccctcagccagcaagcaggcatgccgccgggtgcagcagtatcgtgttagtgaacagtgcatcgatgatccggccgtcggcggcacatacggcaaccttctagcgcagatcaaccacccacaccccaccagcccaccacaacaccacccaaaccaaaccagcaaaaaataaccaccaaatgaccatcacgacgacaccttgaagtctaaacggacaagttactggttactggccgggcgcggctttacccgatagcagcggacggctgtcaacgcgatacttcacgcccccatggccaagacggctcactgagcaatgatttcagtcaccgcctagaatcgcacttcgcgcctggcagatgaaatcatagtcagctcgggtaagaacgatcgagtctatcctagaccccaaacaccacacgatgtcgatcacgcactgaatggtcggcagcacgaaaagcgtcgtaagtgccgcctcgctgcccggtaggaactgcggcagcatcgcgatcccgagggtggccgctttagggttggcactacccaaccaccctaccgtcatactcgctaaccgtgccgccacggttgatgcgctctcaggcagcagactctagctatgctagactccaaagttgttcatgggcatgggctgaattaagaaagagctcaagatctgtgacgctagagttggataatctaggggctggcaaacatttggttgttttgcggacagtgtagggcccaccagcccccaaaagggatcataacatggcgaattcttcagcttcgaggataccatgtgctacctgaaaccaattgctggcgaatatcttttggttcatatcggtgtacacaccccaggcgaccgtgcgtcgagcctgacggttgggcaacggctgccaactgctcgacgtcaccgctccgcaactcgtgtcactgatccggtggatacaccaggtggcatcggtttgcaagcagcgatccggcacagcttgaagtgtcgctgagacacaagagcaccacgatcgatgctgagtgagcgcgccggcaccctgattgatcagggcgccggccgaatcgtgttggcaatgccgccgaccaccgatatctaaaatgctaaagacactctgtcgttctgcacgcagcggttgtcgttagtctctgcggaacttgcgcgatcagtaaagactttcacatattcgaccgagcggtcctcagtgatttggtgaaacggtacaccgacaatgccgataaccattaattcgattctgcagcaaaaattttaaccttcaccgccgagtaggcgatgcctgatccaccagctgaaaacctcagccatatgttcgcagcccgcgacgacaacagctagatgggtttctgaattttcgctacggcgagggcagtgaaggcgatcacctgggtttgtgctatcctgttgaccattggccatccccgtgtagtgcagcgggtcggatatgtactagttgtcctgttccagcagccactggaacaggacaacccgaagcctggttccttcactaaaaagacatttcaccgcaaccactgccgcaatagactcctagcggagaccgtcgagtgcaaggatttggagaaaaagactttcgtgattagcagctgaaggtctacgttctcgtcgaacactctacggagttctcgttcgacaccttgaagaagctgccttaccgctgatcagatcagccagcacttttgaatccaatctcgttctgccatcgctaaatagtttgatgtgcagttaatataataacggaaattatcaaaccgctaccctaggagaattgtgtagtgttctattcgatgggcattggagcgatcgggggcatttactacaacacgcaccacatcgggtcagatgggccattatatgacgatgccaacctacagcataaacgaccagcatctcgccctagttgtacggcaagctgctgcgcctgcgtgatgaattgtggtacggcttcaaactcaaactaatgaagtggatcaaagggaccgagctcgtcgtcgactattccgatatcggtagcggttacggtgactaaaacaaaaaccactagtatttcgtgctatgtcaggcttctagcggaccaacgagtgtctatgctaaactgctcttttctactagtgtagtagagtttagtaggtgtttccgtacacttggctcctaggggtcggcccaggtggcttctaactggtgggttacatcgataacttgtgcggcttgagattgaggggagtcgatttcggcagtgacgtactgtgcgacgaatcgccggatctcatcgtcaatgcccgcaagcatgcgtaacacttcgccacggatggacttagacgacacgttgacagtgatatcggacggcaacggtttctcaacgttgaccatgaggagcagcggcttggcggcacgtgcagttgctcgcaacgcgatgtcgccggcgacggtaaaacgctgcttatcgagccgaaggtcgacgagtagatcgatcgaaagcggaatacgaatgacaaacgtgatgttgtcgcctaggtgccgcgtgacccgaggctctctgagcttgaccttggcgctgaccttggcgatcttgccaggaccctgaccaatcggctccattgagaactcgttgcccgcaatgtcggcgaatgcagcggcgacccgggccggtgtgacggcgacctcgaagaatttgcgaccgaactcttcgtaggtgagatagtcgtaattttgcataggaaaacaccgtacgtcacctgccaaaacaaccgttgatctgctcgcgtcacagacaatctggcctcgactgtgcccttagtacgtcgggcgcccgccggccaagcgtagccagaattggaaggtgtttaccgtctcatgtaagtgcacaaatccactgagccgcgcgctccgtgcccaaaatcaggcggctgtctacctgactcggcgatgaacaaaccccgtcgatccgggatatcgctagggcaacagcatcaactgcggtcacccaccgttccacgccagctgcggcccacagaataacggttgcgctgtgacgatctttcgagcatttgcagatcgacatggatcttgaggcctgcgcgacagtgataatggccggcgccaactacccaaacagagatcaatcaggttgcgaaaaagcacagttcacgatcacagtcggctcttgcatactgtgccatgatttgtgcatcgtcttcattgttccaaagcagcgaccacattattatatgattgtaatcatgttgatatagatgctgaagacgaatattcatcgagtaatcgacagtgaaataagcatttcagatttttaggttatcgcttggcatcagagctccagcacgcgccgggtgtagtcgttaataaagatgccgtcagggtagaggcggtcgcggatgccggtgaaaaagtgccatccggtctaccgctcgagcaacgtaccggagttctgatagtgacgcttgccccaacgtggccggccggcatattcatccatgattgtctcgatgacacgaaaataggtctcgaattccatcacggtgtactgatggacaccgaagtagcagtctgtcacgcctatgctcaatagatagtaaagacatcgtcagacaccgctaagcgcacctcgagcgggaacatgatcggcaagttgtgacggcgcacaaggtcgacgatctgctggatcgctacgcgtatgtgcccgtaagggatcgaatatttcatctcggtgaacttgaccttccactcgatcgcgtacaccttgtaggcttagtcctggacggtgaaattcgagatcaccttcttcataaggcgattaagagtcggggcggtacggagaaagtggtgccccagtacggaaaatcatgccccgtcgcccattttccacctgctcgtgggcgattcatcggtgcatcgggtagattctcgtcaaagccgtgtcaaaataaggaaatacagaaaatccaaagtggtcattgccatagacatgttcgtcgaggttttccaggatattggttagcgtacgtcgttcgtcacggcgatttagagtgtagagcggcaccgcttggacggtgacttgcgagattatccctaacgcactcagcgacacccgcgcctagctaggcaccagcgtttgagccttccgtctaaaatttacacgtcaccggttacggtaacgtgtcgcaccgcaacgatccgcgccaacaagttcggaaaacgtactccggacccatgcgtcgcgatcgcagtagcgctgatgatcgactgggcatcgaatatcactctggttctccaccccgcgtccgtgcacagccagctgcagaccttagactatgtatgcaactacgcaccaaacctcaatcgtcaccaaaccagtttgcggggtctgcagctaatgacctgctgtaagaatggtcatgtcggccatcactgcgtcggtgagcgcacagtcggtgacccaatgcctagtgcccgtactgattcaccacgctaactctgcccgcacaaccgcctcaatcagtccagcctccgctccgaggtcgtccacacaatcgccgacgttgcacagaattgctcatcggcacagtttccccacactgacgcccactccacacatcaccgcttcaacaagagtgaacacgtacatcacggtctcgtagaccaggctatcagatgtattggagatctggcgataattcgagaataccttaatagggtattattatagcgatagatggataagaagcacgcggggttgaataacctgtacaactcataagcacggtgtctttgccgttgcacgctcatatgcttctgtgtagcagcatgttggcccgtaccaccggatcatggaaccgtcgggggtagtagtcttccaagttgtggtgccctcgagcatgatcagctcccagcacgccgatcgtgccgaaattcagaaagtacgtttggtcgcattcaaactcggatttgtgacgagccatgaagccgcacatgccgccttgcaactgttcctctgcgcccagttaaactagcagtactcggttaaactagcagtactcgcccaccgcatgctggccgatcgcgcagcagttcggccaacgcgactagcagaacaatggcagagcagttatccgttagcgcccgagacaattgggctgctaacgatgttgactaacagtgcaattgtgattgcgcccattatggcgtcggtgactatcattttacgactgccccgcagcgcgccgaagacagcaggccgccggttggtcagcaaagtgtcgatgcgctcaacaatcccggggaagcgatcgattattacctattgaaagtcggccacaaaaaacttgccgttatgcgccgcgtcgtgatgagcacacaccacaatcgtccgtgtaccgttgagatcgccaacctcggccaccacgttccacgttgtccgaggcttctgcagtgtcctgcgtaccaccctcgtccccgttagaacagtcatcggcgatcgccagtccggcacccaggcccaccaaggacgcctggcctgaaacgtcaactcagcaagcccgctacgctgaccgccaccccgaacgctgtcagttttgcgtgcagtcgagggtagccatcgtagaatggtgcttcctctacgtgcgcattgtgtgcgctcgccacacttaagtgcttgacgacccacctgacaggctgcggctgaccagcggcgcgctcgatcggcacgaacgcctccgcaacttcgcgcatcgtgtccagctctgttggcaatgcggtgtttgcggtcgtggccactcctcttgcacgccctagattatactgctggaccgcgccgtatctgtccgataggcatccggatgagaacttgctccactacatatatctatattatatcggcgggaaatttgtataagagaaaacacattccgcatcagaaataatgtgcggccctcaacacgatacgtcggcacagtgtcaccggtctgcgtgccccgaatcagatgcagacaatcgaaccactcccacaattcgctggcctttgtgtggcggaaatagacctcattcaccaccagcgtgagcatcggccgtcgcgcggtctccgccgccaggcgcacgcgttccggtgtgtgcagtggcgagcacttcgagcatgcgatcggcgcccagtgcgagtcgttggcggtgatcccatcgcactcgcgcagtgtcgctcgatcgagcgtcgggtaagcgaacaacagattcgagaaaccgcgcaccacaagccagagtgtctcgggaagggtgaatgtcattaggctgtcgaaccacccactggcatcgagatttttccgttgcagcggccgataacacaaatttggacccacccggatcgacttttcgcctacgcgcgtgaggtatttggcgaagagaaggccacctggtggcagcgcgctgtcgaggtctggccagactacgtcaattaccagagctgctgacgtcagcatactgggtggtcctggcttgttgtcgtgctagccggtcggcgaggatttcacggatgacttggcgagcgctgtccgctagccgtaggttggtgtccttgtagcacgggagtgcgatgagcgcactcgacagtgcccagccgctaccgcgtacccaagcgtcgtaatcgaccccagcaaggtgcgaaactactttcgcacaagtggaggtagcaaaactccatgcgagactcagatcgatgctggggtctcccaagcccatgagatcgaagtcgataacgccagtcagtcacccccggaccgtcaagaggataggttaccgtggaaacatatcgccggcccgcgtacaccggtacccgtagcacctcctcccaggcagaggtggccgcccggacattgatgagcccatccagggccggcagtgcggcggggaccccctcgtctcgcatcgccagaggccgcaccgatgcgcgggcgacccgacggtgagatcgatggcgggccgggcagtgattgaaggcgatgagattctggacgatcccggtggagtccattaggttcagctggccgctgggttctctccttcgacccagcggccagctggctagggctatccgaagcgctccgcggggtgcccaggcccgccgggatggggctgggcaccgggaagtgcggggcgatccgcggcaaccagtgctgttcggtccacaggctctcgacagcccggtggatcccgggaatccgggcagcaaggttgtccgccgagccggtacatggcgttgtcagtctatgcgaagcggaccggagtaataaggggcaggtcggctcaatgagggaaccagatactcagcagccatcgcaccaggtgttcgttgatgtccacctcgtcatcgtgcatcttgccaatgatctttggccgcagcgcttttcaaagccgactgctgccgtccagcagactgctcaacgctgtccgggccagcttgcgaacgatgattccgagagcgcggctgatgtgtcggtggtcaaacaaatcgtcaccgtgccgttcgaagaggaacgcttccgcgccgcatcaacggccgtcctagaccgcgccccgtgtaatgggatcgaacgtaacaggcgaagacgctaccttgtcatcgcaaagccggctatcatcggcaccataaacctaagcgatccacctacaagggaacacctgcagcgcgtcttatactgtcttgtgtgatcccaagctcgtccttttaggttatcctgcctaacccgccccttgactgaggtctcgctcttagcggtcgaaggctgtgccgtcctattctcggagtcgaccggcgtgggtgaagtcggtccgtagcgcgacccggatggatgccgcgttctccggctccacctttcaccactgctgtactcgtgtactcgccaccgtgctctgccgcgtactgaccacgccaggtcgacagcgcggatcgccaacccacgtccacaccaggactggcggcaaagctcgtaggcgacgctgaactgcccagctgccaatccctcatcctgcctaatcgcagatcgacggtctcagccagtacctcctcggcgcctacggcgcggatagcgaaggcccgcagcggaccgctggttgcttactgatgctgacagtggcacaggtaagcttcgcaccttggtgagtcctgggctcgaccgagtatcagcggaccagctgcttgtcctccccgccatatgtgacactgcatcatccacgcgcagcggggaaagaatgtaggatgccgtcagacaagctctgattgcgcatcctgtgattgtcacgatcgaaatgcctcccgacaatcggatatttcatggacgttccgggcatcacagaatggtcggcaccgttgcggaagcctaatcgggcttatcctcaacgacgttcattcctcccgaaaagacccaacaaagccaataaacacacggatgtcctaaacgcttagccgaaccaactcaagcgcgctgggcagccaatacgtcaggaacacatctcagcaatggccaacaaccaacccaacaaatccggacccatttcggatttaatgtcgattgcgataatgcgttgtccacggttgcctaacttccaggatgaagtcggcgtcaactcgagccgtctcacaggtaaacacgccaacaaccaacgccatgccggtagcaccggagccaacaccttcaactttgatcacctcagcgccccagtccgacaatccgaacaccgctgaatatgcctgacatcgccaacttgctcggtcaccagcatttcttactattttagatattctagttactgcaaaggatgtggacgaattcgttgataccatgggctggtatcgagacgtctccagatcgaccacagttcgtattctccgagcaacgctttatggtgctgcccatccagatgttcgacatcgatgctggtggcaattatgcattcactgcggccagaaatcatgtgccattcacttctggaacgcctcataattgttcctctgaactaaaccatgaaattcggtaccgggaatttcggcgagcatggagtcaccaacaacgccttggtaaaggacattctccgctttctcgtttatcaaggagtcaggttgagatcgctgaaactgtatcattgctcgataccaatttctggccgcaccaaaggcctttctgaaaacacagaggcctcgacggtccctatcctcggcaaggctcacttgactattagtaccctgattgcgcagagccatggccctaaatcgatatcagcggaacagggcattcgtgaactgacgagagaggaacagcagctcaacacctatttctttcggtcgggctgacaggatttgaacctgcgaccacttgacccccagtcaagtgcgctaccaaactgcgccacagcccgtcgtgctaagtgtcgccggttgatcggcggtaggctgtcagcctaccgccgatcaatcccaagcccgactaccacctacagctcacggatccacaacaacgatggacatatacagtagatacccaccggtcgtgtctccgctgaacaccagcctccccagtttggaccaacccgatggccctgcacagcttgaccatcaagactaaccagatcaatgttgtataaccaaatatccctagttctgcatacgtagatcgtggtcactggtgttggtcaataccaaactgagtcatttggcggcttgaaaggattcctctatacgccaacgttgactggctacagcgtacagctgtactcaacggagcggggtgtacaatgtagtagttcagttaggacaattcgccggtggcatggttgtggcgtatctgcaaatgacggccctcggtgtcgtcttcaggctgaagcctgctctagtctgagcagcagtagtagtcgatgtccgtgactggccggtgccggcggagtgtttctgccaaacccagatgggcagccgggatgggagtcaatccacgcaaatcggaactgctgcagttggcgcgcgccgattggctgccacggccagtactttagcccagaccgtgaccgcggatggcagcccgcagcttgggtcgactccatagacttcgtcgccggccacccaagctacgggcaccttggcctgcacagcgcgagcaaccaaagctgctgccagaagtaggtctggtcacgaaactctttttgttggtggggatcgcggcattgtctcagcgactgggatcttcggtccatgatcgtcaggataggatcgattagggcatgtccacgcgaagcggcatagatcggatagaccacgacttgctcgttctcgatgcacccagaagggccggtgtactgatgttgcaccccgatcgaatgaatgcccttttcacgttcccggtttcgtcaacgaccagaatcgctgaaggcgtcaacaacggagtagcgcaaatcatagcgggccacttcagtgtcccacttcacccgtaacagttaggtgctgcaacccgtctagggtggcatcgcctcggtgctcggcaatcgtccagcaattccggtccagcacagataaccatacccagcatgagtccgccggcatgtcgcaacggctgatcacgagcgaaacatagtgcgatccgatcgatcatcgccgagaactcaacccaccaccgatcaaggtttacgccatgaaaccgcatcgtaattcagatgtactcaccaactccgagcaatgccccggttaactcccccaccagcacagaaacgccagagtccatggttccaatctacggctaaaatgccaacagtaaatcagactgctgtgcaatacttttagaaacatctcacatatactcgaaccagcagttcactttatttcaatccacgctagcagagcctgagcaagttcggattctcatccgtagaaccgtcgcgtcagaaccggcacgctgactgccaccatttgctcagttgccctttgcggcgccacgtccactgcgcagatgtcttcgctttgttcttcgcggccataggcgacgaacttagactcgaatgcggtcgagctccttgtgcaacgccgcccaggtcgtgctggtgctcgcggtgagccgaatgagtagactgggcagcacttaaatccgtcggacaggcggcaggctggctagaatcgctttgccattagcgcagcagtacagcgagaacgattcttctaccgcactgctggcctgaagacggtgcggcccaatgacctgatcaaagaagttggcacgatctccgtcgagcattgacaggtccaccgtttcttgcagctcgcaacacagctcctcaagaaacggatgcagatccataaccaggaccggtcgcaccgtgcgaactctgcgcgcaatctccgagccaagccgaaaccaccctcggaccgtacctgggaccatcaacccttcgtcgtgcagggcgttgagaatccggctcacggtggaaagcgccatgcccagccgttccgccgatcacagcctggttgaggcttttgaaatgagcctttagcagccataaataatgtctcggccgggcgggtaatccacatggataccgcccgtgtcatgttcttcgacgttgacactcattgaagatctcccagcggacccagcaggacttccgcaaaaacagatcgtatgcgacgccagcggcgcgtgtcccgcgctaacttgccagctcgtgtcagggaaaaagctggcgcaccatcgtgagcacatgatcgacgtggtagccattcttccggttaaatagatctgcacctgcggagcgccttcatgataggcctccgccgctgccttcacgatctcctccgaggagatcggaagcctgggactgtctagactagccatcggccgcaatgggtccggcggatacaacggtcttggcaacgctcacaccgacgtgggccggccccgcggccttgctagccgcacgatgaatccgtcaccgccaacccagcaccatgggaacaccacgaaggttacgcgcggacgctgaccttttccagctcgcaaccaaagttctcgaagccgtagatggccttcgacaaaaccgcccggtggcccagctcccactccgagaagtcatcgagcatcttatggccgacctcttcctcgtattcgtgcaccggccaaggaaacaaaccatccaagtgttcgccgagacagtgtgggtcgagcgaagtaagccatcgggtgatacaacaccgtggtgtcagtaccgagcgctttgacgtccttggttacgaaccacactcaccagcttccttccagaatcccgatagatatagatatagcatgaaagccatataccataaggcgctatacaacgtatttatgtggtgtctcccggtgttgaaaatgacgatgtcgccgggctagatgtcaggtgcgactttctccgaatcctcggcgacgtagtgattttctaggtcaagactagtcccctggccattcccctgactatgttctgcaatcactcgaatttggcgtctttgcttattacaccgacaccagcacaccgtgacgccacgggtgcgccaggccgtagaactgcattttgcttcggctgccactgacagtccaggtgaaagtcatggtctatttcttcctttcgtttttcgtctctattcaacggcgttacacagctggactgactcggccagccgcgcgacggtctgctgtataggtggcaattgagcctcaagatcactgtttgtccgctagccagatggaccacaagcgatgtcgtcaacgacgtctagagagcctaagcttggtagcccaaaacaaccgacggcacccatgatcgatatcgagcttccctacaaaacaaactgaaccgcgccgtcgaggtcgcgctgttccacaaatccctctacacggtctttagcattcgggacacgcaatggtagagcagtattagacatataaaatatataactaagatttagcggatctacaagtcgaaagacagccatatatccgacgcgcttgacaactaatcgtcaggttgtcaactaagaaattacccgcctgtgaatgcttttgcttcctgcagataatgcctgcgccgcgtcacaccgtctcgatgattattcgtatatgcgttcgatctgtacggtcacaccgaccgaggtgactgccgcctgcaaagcaatcgatgcagcggtcacggcgatccgcgagttgaccgtggacaacctggcacctgcacttcggctagcgggtgttcgagcatctggagatgaggcaatgtcaacagacgatagtcagccacgacattgtccaaagcctggacaaaaatgatctcaccgccgtcggacggtactgtccacagagtggtcactaactgcttacggatcagctacgccgaagcccggcgcaggctaaacgacgctgagtaactcactccgtaatttactatgaccggcgagaatttgccgccggaattgccggcgacggcacaggcgtggcgagccagcgtgttgtatggacagcacctgcagttaattagacatttatgcgtaacctgcccgaggtggtcccagtctactagtcgaccgggccaagcgtttccttgccgagcaagtgtcgaagctgcgcaccgatcaactagaaaagtcgctcaaccgatgcgcgctgttgatcaatcccgacgacaagttctcgaacagcaaccaagcccgacagcacagcgtcgtatagtcagctcagcaccacgacaggatgaacataggcaggctgatcgcaagccttggactagcgcgccaacctcgacgcctagttggcccgattcgccgcgtcgggtatatgaaaccccgacgatcaaaccgcctgctttggcggcgaaccccaccaaggaaaccgcgagaaaggagctgcgcagccatgcccagcgtcagtacgacgcactcaatatcctagtcctgtgccagctaggcaacccgaaattcggtacacacaacgatttgccggtgatcgtgaccgtgtctaactaccctcacagaattgacctcaactgctggccacgcggtaaccggcaacggtacgctgttgcccacacgcgacgtcatccggatgatcagacatgcctatcactacctggtcgtgtttgacgaccatcaaagccgcccagtgcatctcggacgttcacgacgaaatcatttcaccggatcagctcgtgatactctaagcacaagatcgcggctgcacgtttccgggttgcgcagcgctctgttgtgtatctgagacgatcactacatggacgagtgagccgtcagcggactgactaacatggccaagttgacattctgttgtcttccatatcatgggttacacgaaataggttagagtacaggcaaattcgcagaagtaatgacaaggaatgaccgagtgaatttcttctccatgatcaccaatggtatatgataacaacgactttcaccatccggagcactaacttccggatgacggctcagcctagcgacgatgcaacacagttagcggcgcttgagtccccgtttttcgcgcactcgcacattgatccggatcggactgccctcaaacccaaacgtctcacgtagccgacgttctaggaagcgtcggtagcaggcttccagaaaaccagtcgtgaacagcacgaacgtcggcggtcgagcagtcgcctgggtagcgaatagtatgcgcggctgcttgccaccgcgcaccgggggtggtgtcgccgccaccactgccttaatccatatgttcagcgggccggtcgcaattctggtatcccacgacgccagcgaattttccatcgccggcaccagtttctgcaccgcccggcccgtcttggcggagatattgacccgttgcgcccaacgcacctgcaccagctcacgatcgatctcgcgctccagcagatcgcaccgatcttcgtcaactagatcccacttattgaaggccagcaccaacgcgcgaccagcatcgataaccatagagagcacccgctgatcttgtcccgttagcggctccgatgcgtcgatcagcatgatcaccacttcggccgaatcgatggccccatgagtgcgcaccgaagcatagaattcgtgcccgcttgcctgaccgacttttcgacgcaaacccgcggtgtcgacgaaacgccagaccctgccgcccatttcaataagtgagtccacagggtctactgtcgtccctgcggcctcgtggactaccgaacgctggtcacctgccaacttgttcagcaatgaactcttgcccacattgggcttgccgacgagcgccacacgccgaagaccgccgtcaagcgacgtcgattcagccacgttgggcagtgcggccagcaccttgtcaagcaggtcagctacgccgcgaccatgcatcgcactgattgcgtgcggctcacccagtcccagcgaccacaatgccgacgcgtccgattcgcccttttcgccgtccaccttgttggctgctaagaataccagcttacccgagcggagcaaaatccgagctgcggcttcgtcggcgtcagtggccccgacaccgacgtcaaccacaaggatcaccgcgtcggcggtgcgcatggccaccgacgcctgctccgccaccagccgtttgaggcctttggcgtcgggttcccatcctccggtgtcctgtacgacgaaccgacgtccggtccacattgcatcataggagactcggtcgcgagtcaccccgggaacatcctgcaccaccgcttcgcgccggcccagaattcggttaaccaacgtcgatttgccgacattaggcctgcccaccaccgccaccaccggcccgaactcggctagatccgaatcgtcaagttcccagtcgctttcgtcactccaggtgccatcctggctcaccacaccgccccactgcgctgcttcaccaagtccattaggtgggcgatcacctcggcttcagccatcttgctggtgtcaacaatcatggcgtcttgagccacatacaacggcgacaccgcccgggtggagtcgagatggtcgcggcggcgcacttcggccaacacgcggtcataatcgtcggccgaacctgacgcgacattctggtcgttgcgacgtcgcgcgcgggtttcgggcgatgccgtcagaaagatcttcaccggagcgtcgggtaatacaacggtcccaatatcgcggccctctacaacgacactgcctcgcccttcggccatctgtcgctgcagatcaacaagccggacgcgcacggcaggaatcgccgacaccgccgacaccgcctgggtgacctcctcagtccgtatctcagatgaaacatcctctccaccaaggaaataacgatcatgatcggagagcatctgcactttccaaacactctccccaatcgctgcagcatctgctggatcaattccggcgcgcagcaccgccaatgtcatcatacggtacattgccccggtatctaagtagcgcgcccccagctcacgcgctagtccccttgacacggaagattttccggtccccgccggtccgtcgatggcgacaacaatatcggtcacaggcccacctctttatacagttgtctgatctcatcacggagcaaagcccgaaggcagcccggacgctgatctcccagcgacaccgcaccgatatcggtgcggaccagcatctctacagggaagcctgcagctgtcagtagccgacgtacaatgcgcttacgtccttcgtgcaacgtcaaccgcaccaacgtcttacctgggatcgcgtctaccaccgcgaaatcatcgacatgcgccgggccgtcgtccaactcaagtcccacgcttagcttcttacctaacccacgcggaaccgcccctttcaccgtcgccaaatacgtcttggacacctcatgggacggatgcatcaaccggtgtgctaactcgccatcgttagtcaacaagatcagcccttcggtatcggcgtctagccgccctacatgaaacagcttcttattgccccgcacccggcgctcgatcaaatcaccgacacagggccggccgcggtcgtccgacatggtcgagtacatgccgcgcggcttgttcagcgccagatacaccagcgagtcgtcgaccactaccttgaccccatcgacccgaactaccgagacatcgggtcgacccgggtacccaactccctcaccagctgaccgtccacttcgacacggccttcgatgattagcttctcggcggcccgccgcgacgcaatcccagcccgggacaatatcttttgcagacggaccgccccagcaccccggtccatcctagaatcgtggatctcgaccatcaatcctggttcacatcgaacgaccgtggctgcttagacactttggcgccggtaagcttgatgaaacgtggctttttgtccagaaactcgctcatgtcttcgatagtgtcgacgtcgggaagcagcggcgcgatgtcgggaagctcggcaagtgaggtcaaccccaagcgctccagaaatagctcggtggtcgcgaacatcaccgcgccggagtcgggctcagggccaacctcggtgattaggccgcgcgccaacaaggtgcgcatgacggcgtccacattgacaccgcgaaccgcgctcacccgtgcccgcgtcacaggctgacggtaggcgaccacggccagcgtctcgagcgcggcgcgggtcagcttggtgcgcgcaccatccaacagcagcctctcgacgtagggtgcatatcgggcacgggtgtacaacctccacccctcagccgagtgccgcagatcgataccgctgtcgcgttcggcgaattcgttaaccatcaaccgcagctttgcagcgatccggtcaacaggttgctcggcggccgcagctagtgcctcgacagtcaccggggtgtccaccaccaacaacagcgcttccaacacacaaccgagttcgtcggcatcgagctttgacgcctcagctatgttcgggattccagagtccagttcgagatcgggcatttcttgggtcaagcaccgctcctcctcatcgctgcgcctgcatcgtcgccgacaccaatcatgattcgtctcgcacttctgccaaggcttcactggctagtcgttccccggcccacgaaacttgaagcacaccaagtggctcggcctgctcgaatgctatcgcccgggtccgatataattcgagcagagcaaggaagcacccgaccacctcgatcggctcccggcagtcggcgaccaactcagaaaatgaggtccattggccgttgccccgtgcttcgagcatcgccagcaatcgtttggcttgctcgggaaccgagattttcagctcgtgcaagtgcccggtggccacaatcggcactggccggggggtgaacgtgaacgcggcgatctcagcaaaccgatcggcgtcgacgccgatcatcacctcgggaagcaggctggcgaaccgctcttccaagaataccgcgtgtggatagctacgcagcgcggtggcttccaactcggcgaatatctgcgcaacgcgcttgaacgcgcggtattgcagcagtcgggcgaacagcagatcgcgaccttccagaagcgccaggtcctcttcgtcctcgacccgcccggctggtagcagccgggcggccttgagatcgatcagggtcgcggcaatcaccaggaatgctgtggtttcctcgagacccaattgagggccgagccgacgaatgtacgcaatgaagtcgtcggtgacctggtgcaacgcaacctcggtaacatctaggcggtgggcgcagatcaagtgtagcaacagatcgaacggcccctcaaagttggtgagccgaacctggaagccgttctggtgtggagcctcactgttcacgcgccgaagcggtcgatgaattcacaggccaatgcgcgataggccctggcgccgcccgatttcggtgcccacgtggtgatgggttcacccgcgacactggtctcaggaaaccggaccgtacgggtgatcacagtgtcaaagaccaggtcgccgaaccgttctacgacacgtgccataacctcgcgtgcgttgacagtgcgcgggtcatatcgagtaatcaggatgccgctgatttccaacttcgggttgagccgatcacgcaccttgtctacggtgtcggtaagcaacgccagcccacgcagcgagaagaattcgcattccgtcgggataactacgccctctgcacaagccagtccgttaacggtgagtaggcccagcgaaggctggcagtcaatcagcacataatcgtagcggtccagtaccgggtgcaacgcccgcgccaaggtctgctctcgccccacctcgttaaccaactggatctcggcagccgacaggtcgatattgctgggtaccaaatctaagtatctgacccgtgtgtggatcagcacgtcgtcgatcgataccagtggttccaccattaggttgtggattgtccggtctagctcgtaatgcggtacgccaaggcctgccgacagtgcgccctgcgggtctatatccaccagcagcaccctccggccgaattcggtgagggcggcacccaggttgatcgtcgacgtggttttcccgacgccacccttctggttgcacatcgcgacgaccttggccggaccgtgcgagctacgcggcctgggttctgggatggcccgtggcggccgtccggtcagcccgatctctacaacgctatcgaggtggtcgatcattgccggtaacgactcatagggacaggcatcacggtgagcatcgcaggaaagtctaacgtctgtacgcgcccgagtttggagacccacagtggtagtggggcggcaattacgataatagcggctctgtcgaccacagggagccgccacagcaccaagcagagaactatacaggacactgtgtgccgtaccgcacagctgcatcaaacctcattctaatcattgcctttcgcagtagtaaggcgatccccaatgaaccacgaattcttcactgaaactatcaatttcgtgctcctctactacaacaagaaaggtctatctcgacgatctacaaagcattaccaacctgggctggctacatcggggctcgatcgtggttacctgcaaggtcatggttcctgacgcaccgaagtaccgcaaatacatgcgaggccagcaaggcgcgctatggaacaccatcgagcacaagacgcacttcaaatagcagacgctggcgcccagtctggtgatggaattccaaatacctgggctgaaacgcggagctatttggccctagggtgcgccccggcccacacttcacgtaacgcctggacagtaaccaacgtgtagatctgcgttgtcgtgaccgaggcatgacccattaactcctgcacaacccggatgtcggcgccaccttcgagtaagtgggtggcaaaggaatgccgcaacatgtgcggcgacacacccgaagtgataccggcatgttcagcagcatcttgcagaacttgccacgcactttgacgcgacaaccgacctccgcgcgcattgagaaaaatggctggcgtcgcaagcattccaggaccccgacgagccagatcggagcgtccacgcaccagataggcatccagcgcttgcacggcgggacgccccaccggtactagccgctgcttgccgcccttcccctgcaacaacaccgtcctggcctgggtgtcgacatcgtcgacatcaagcccaacagcttcagaaatccgggatccggtagagtacaacaactccagcaacgcccgattgcgtagtaccagcggtccgtcggccccactttcgccgcccacactctccagcaaagccagcacctcgtcaactgtcaagctcttgggcaaccgacgtcctggcgtaggcggacggacagctcgcgcaacatccaggtcgaccaacccttcggcgacagcgaaccgatgcaaaccgcgcactgcgatcaacgctcgcgccgccgacaccgcagacagcgccgccaccccggaatcgggatccccacggcgcagcgccaccaagaactcgctaacatcgtgctcaccgaccttggccagatcctcaattccccgatctgacaagtgcttggagtagcggatcaggtcacggcgataggagctcagcgtgtttgccgctatactgcgctcgatgatcagatagtcgaggtagccctgcagctgtgtctgaagcgcggccgtcgtcactgggtgacctttcgggccgcaagcaccgtttgcttatcgatccactgactgtttagtgagcgcgattgcacgaactcggtggtcaccgcatgggcggctaaaatcccaacaattgcaataaagttgacaatttcaccactgaacacccgtcggactgtctcgtcgataggcggccggagcatggtcatgtcggcctcttcatcatcatgcgcttcgggtcgggctacttcacttaatccggtggctagatagatcctcaccgattcatcgcttaagcccggtgcagtgttgaagtcgaccagcacctgccagatgctgacttgcaagccgacctcttccttaaggccgcagacggtattcagatacggcggctcgcctgcggcgtcaagtaagcctgccggcagctcccacagccacgaatcgtacgtgttgcggtaccgatagaccatcgggatgctgttgccgtccatcgctgcgatggcgactacactgcactgctcaacgacctcacgtgccatgggtgcggccaccgagcatcggtacctggtcgcgacgcagcgcagaaatgttaccgcgatccgccgtttcgaacgaagtcgtcttgaagacgtgctcagccacgggctgcaggtgccgggaacgaccgctcgacgccatctcgatgctggttactgctgttgggcaagtgctcagaaatttccgggaccgcaggtatctccacagggagcaactccgccgacttgtagtcgatggccgccccgacgaaagcgacgaacagtggatgcggccgggtgggtcggctcttcagttcagggtgagcctgggtgccgacaacgaatggatgcatgttggccggatattcgacgaactccaccagataaccgtcgggcgaagttccagaaatccgcagcccactttcggcgatccaatcgcggtaggcgttgttgacttcgtagcggtgccggtgtcgctcggacacctgcgttgtgccatacgcttgggccacgatcgaagccggttgcaaaaccgcgggataggcccccagccgcatcgtgccgccgaaatccgcttcgccggccacgatctctttttgatcggccatcgttgagatcaccggatctggtgtagctggttcgaattcggccgagttcgcttgcacgagaccgaccgagcgggtggcctcgatcacgatacattgcaaacccaagcataggccaagcaccggcagcccccgagcccgagcataccggatggcgccgatttttccttcgattccgcggataccgaacccaccagggatcagcacaccgtgaacgtcggccagcaccgctgcagcgcccgtggcagtttcgcaatcgtcggaagccacccaaactacctcaaccttggcgtaatgtttgaacccgccggcatgtagcgcttcggagactgacagataggcgtcggaaaagtcaacgtacttacctacaagagcaattcgcacagtcccgtgaggctcgtgaacacggcgcagcaagtcgtcccactcggtccagtccacgtcgcggaacggtagattgagtcggcgcaccacaaaggcgtcgagttcctcacgatgcaacactttgggtatgtcatagatcgatggcgcgtccggggtggagatgactccatcgatatcaacgtcgcacatcagcgcaatcttgttcttcaacgattcgggaacatctcggtcgcagcgcaggatcagggcatccggggtaataccgatgctgcgcagcgcggccactgagtgctgggtaggcttggttttgagttcacccgaaggcgccaggtgaggcaccaacgacacatgtagaaagaagacgttctcccggccaaggtcgtgacggacctgccgtgccgcctccaaaaagggctgcgattcgatatcacccacggtgccaccgatttcggtaatgacgacgtctgggcggttgtctccgccgtcgggctgggccatcgccatgatgcgctgcttgatctcgtcggtgatgtgcgggatcacctggactgtgtcaccgagatattcgccacgccgttctttggcgatcactgtcgaatacacctgcccggtagtgacattcgccgagccggacagatcgcgatccaggaaccgctcgtagtggccgacgtcgaggtcagtctcggcgccatcctcggtcacaaagacctccccgtgctggaacgggttcatggtgcccgggtcaacattgaggtacgggtcgagtttctgcattgtcacgtgcaacccacgagcggtcaacagttgcccgaggctgctcgcggtgagtcctttgccaagcgaagaagcgacgccaccgctgacaaagaggtgcttggtagcggattgcgggtgcttacgcactaagacgacctccgtgaagacgggcagcgcatatttttccaggactctgccaagatgtttctggccgttgccagctggatctgccaacttacggaaacccaccttaacacccagcatgctgtggcgcggcaaaacacaccctacatcacatcgcagctactggggtccgaacctactggggcacggtgatcgaggtagccccgtgtccgacgccgtactgcccggtatggccgccactgagcaagtcgtgcagacccaggatcgcggtgatccgcccaggttcggcatcgacgttatcgacggtgctgatcgtggcggccatgccagcatcgggcgggctaccgcacggcgcgactcccgtcgccggccgtcccggccagcaagcagggtgccagaaccatcgggagcgagtgcggcggaaaaccgggccacgctgaccccttgattgccggcatcttggggtagtaaaccgccggtaatgactagcgcggcttcgccgcccccaggtgatcatttcgattgtaggtctggtaagtgatgaaacctgtgtcacgcagtgccactaggacggtactgcgctgagcatctccgacattggggacggccgggttagcgttgaccagcaatgtgatccccagcaggtcgccagcctgcgaaccttggtcgacgagcttggtgctcaactgtgcaccggctggcagaatcgacgaattcacgacgctgcgaagcttttccgtggagttggcatcgacaaattccgcgtcagcgacaccgttccggtgaccgtcccgccggcctggaccacgattttcgacaccgccgcgacatcgtcatcttttgcatccggagtgcggaagaccaccaccgacgtgcccccaagcacgtcgtgcacgatccgacctagtagctggttatcgaagttatttgctgcactgactttctcgttcagcatgttcttctggtcgttgagcccactgatctgcgtgtataggtcccgcttctcgtcacgcagactggacaacaaagtgtctgacaaaaatccggaacccagtacaactcccacggccaacgccaagaagactgcagccagggagaacgcatgttggcgtaacgagatcatgagtgcacgtacctcgggaaattaggcgatcaggcgctgtatccaaagggaaaagcggttccagtagtcgataaccccgtgcagcactacaccatcggtgcgtgatacccacaacgcgacgatgactgcgatcaacatgatcaacgccagcaacgcaatagctccaaacgaaatatggttacgatagagggtggcgactgctttggcgtccactagcttttcccccacccgcaacctagtaagaaaggtcgatgggttgctctgcgtacgtgtgcggtcgaagaacgtctcgatattagcagtatggccggccgtgaccagcagtgccgcgccatgatgatcggccagcagtagtgccaaatcggtggccgagccagcggctggaaacgtcatcgccccgaccccaagatcctgaattctttccagaccaggcgcgtgtccgtcagcgtcagcaggcaacaccacgtgagcaccgcacctaagtgcttcagtgctgatctgctcggggtcaccgacgatgagttgtggacgatagccggcctttcgcaacacatccgcaccgccgctgacgccaaccaacaccggctggtactccttgatgaatggcttgagagatttcagatcatcggcggcgctaggctcgtcggcaacaattaccacatgccggcggcgcaggtcgacgtcgatgtcggggatgccaatgccgtcgatcaacaacgggctttcacttttgatgaattcaatggtgttgccggcgaaggcttccaagtgggtggctagcccgcttttggcttcccgcatcagatcggcaatgtcatggtctgtgcgctcggtgccgcagatcaatcggcggtcgccggagtacacgccgccttcatgaaggcgaatcttggcaccgtccttgatttttttgaagacttccggtccggtttcgtcgatcagcgtgactccgttattgaccaaaacctctggacccagattcgggtaacggcccgagaccgacggcgatgcgttaacgacggcaacgatatcggcctccaccaatgcgtcagctgtgatccgatccagatccaggacgtcgaggaccacaatgtcgccggggcagattctacgtagcaatcggtcgatattccgatcaactcgagcggtcccaaccaaccccggccgggagttattgcgggaaagcagtgctgacatcctcatagggcaatcctggcggtcaagtgcggctgagcctaggagacgcgccgtaatattagtatcagaagtttctgcagtaacatctatcacaagatagtaacgatttgatcgcacaaacgtccgcagatgtacaggttttgcggcgtgtcggggtacggacacgatcgctcgcagcagcgcggaccaaattagctcttatctttccgcgcggcatcgagcagttcacgggcgtgcgcgcggccactatcagactcaccgagccccgccagcatccgcgccaactcggccaccctatcgtcgccggccagacgacgcacgtcgctggcgccgtcaagcccggcactgtgcaccaccagatggacatcagcataggcggcaacctgtggcaaatgcgtcaccacaatgacctggtgggtacgggccaaccgcgccaacctacgcccgatctgcactgcggccctgccgccgacgccgacatcaacctcatcgaacaccatcgtggtacccgccgccgaagtagctaacactacctctagagcgagcatcacccgagatagctcaccgccagaggcgcttttcgccagcggcagcaccgtcataccgcggtgcgcagcaaagccaaactcgacctggtcgacaccatcagcgccggctcgggccactccgcccgagggcagcgtgacggcagcggagcgcttatagtcggtcaaaggtatgagatcggtagtcacgctaatggtgaattccgcatcgaccatcgccaaggcagacagctccgcggtcacctctttggccagtctattggctgcatcgcgtcgaagcttgctgagatcgactgcggcttgcgataattggcgttccaactcatcgacacgagattcaacgccggccaacctttcataggagacgtcaagttgctccagccgttcgcgtgactcccttgcccactgcaacacgccatcgatatccgcggcgtacttgcgagtcagtgtgcacagttcggcttgccgaaccagcttggactctagtgcgctagcatcgaccggcagttcctccagatactcgccgagctcgcgacccacttcgacaaccaccgtcagcacttcgccgacttggtcggcgaacgcccgcaacgttgcgtcatcggtcgattccaacgcagccttcgcctgtcccatacaagcaacagcattcgagcctgacacgtccatatcgtcaagcgccccggataacgccgcgcgcgcattaaccgcgacttcacgcagcatgtccagttcggagagccgaacgatgtcagcgaccaacgcgttgtcctcgcccggttgcgggtcaacgctatcgatctcgctcagcgcgaatttcagccgatccgcctcctggacaagttcccgaatccgattgcggcgatctatgagatcgctccgcgccaacaaccaggcatcacgcagctcgcggtagcgctcacaactggggcctgcagccgcgtaacggtctagcgcagcgcgttgctcctcaggccgcaccaaccgcagctgatcgttttgcccgtgcaaggcaagcaactcagtggtgaaactgcccagtgacttggccggcacgctgcgaccaccgagataggagcgagaaggcccgtcgcggctgaccgagcgcagcacgatcacgctgccatcctcatcgcgctctgatcccgacgcgttaagtatcccgtcaagctgcgcgactacaacatcgtctaggtcggtcgtcgtgaaccggccttcgacaacagcacggttagctcctgatcggacacggcttgcgtcggcgcgagccccgccgagcagatgcagccccgtcaccaccatggtcttgccagtaccggtttcgccggtcagtacagtcaggccccgatcgaactcagctgtcgcaacgctgatagcgcccaacgactcgattcgtatttccgtcaacattcagtgcgcaccaggcaacgccatcacttcccgcgccaaccggtcaccggcaaccggaatttgctcaccaagcggtcagtgaacggcgcgctatctaggcgcgcccatttcactggtgtggcacagcgagtcacctcgagccgtccgccggccggtataatcatttcgcggcgaccgtcgcagaacaccagtgcgtcgttgccgttggcctctagctcaattgccacggtagcatcggggctggtgaccatcggccggccgaacagagcatgagcgttgttggggaccaccaggatagcttcgagatccggccatagcaccggaccacctgccgagaacgcataggcggtggatcccgtgggggtcgataccaacaccccgtcgcaaccgaacgtggacactggccgcccttcgatttcgacgaccaccccgagcacacccagccgcggacccttttccaagctggcttcgttaagtgcccacccctgatcgatgatgttcccgccttggcgtaccacgatgtcgagtgttaagcgctcctccacgcggtagctccgcgcgatgacgtgctccagcacaacgtcaatagcctccgcttcggcctccgctaaaaagccgatccgtcccaggttgacacccaacactgggatgcgggcggtgcgagccagctcagcggcacgtaagaaggtgccatcaccacctagcaccagcaccagttcgcaaccctgggcaacgtgcgggtcagcgtcaaccacctcgatatcaacacccattgcacgcatattgtcgagagcaagatgcagcgatcccctatcgaccgcctcagcagataacacccgaagtgcaattccattgtcgcccacaattttctttacacgccgagccgtctcggttgcttcgtcacgtccggtgtggacgaccagcaacacagtccgttgcgccgccttgcgaggagtcactgcgggccttctgcgatggcacgttgcacggctgcctccagcccatcggtcgagagctccagatcggtctgagcgcgtagccacaggaagtattcgacgttgcctgacagacccggtagcgagctggcagtcacatccatggtgcgccatccgagctctgtcgcacgacgcgcgacggccagaaccgaatctgctcgaagccgcaggtcgcgaaccaccccgccgggacccacctgacccttgcccacctcaaactgcggcttcaccatgggaacgatatccgcgctcggtaatgcgcagccagccagcgccgacaagacggtggctaatgaaatgaacgacaggtcagccaccaccaaatcaaccggcccgccgatcagctcgggtgacaagtcgtgcacattggtccgttcgacaacgatcacgcgcggatcgcagcgcaccgaccaggccagctgaccgtaccccacatccacagctaccacctcggcggccccgcgatccagcagaacttcagtaaatccacccgtggacgcgccagcgtcaaggcagcaacgccccgcgaccgggatcccgaaagtgtcaagcgcacccataagtttgtgcgctccgcacacccaactacgctcaccatcgtccgcgacggtcaagaccgtggttatggccacggcggtgctcggcttgaccgccggcaaaccgtcgatgctaaccttaccggcgcttatcaatttcgcggcctgttgacgggaccgcgcaaggccacgtcggaccagctcaacatcaacgcggacacgtcgggccacgatgcagtcaacccttctccgctgactctagagcctgcaacagcacggaatgcacctcggaaaaacggagcgctacctcttcgagctgggcaagagatagcccgcttaccgagtcttctaagtcggcgaagtcaggcagctgggcaagcagggcatcgatttcggcgcgaatctgatcaggatcgatagtcattgcgttcctacgctagtaaccgtctcatcgtgccacacaagggaccagtgatgtaacgcgtcgcgagccggtcgtcgccggcctcgatgcgcaacaggcatctctttaaatgcacatcccgtaccgcgctgactatgacgacacgaaccgtgggagaccccatccatatccccggcggttgccattgccgttgaccgtttaccgacccgtcgtcgatgtctgtcgacacggtaaaccgagcacagccccaccacgagacaattggcgaagccggcatagtgaacgcaagtcgtgcccggatgggcctatgagcaattttagcgtacactacatcccaccgagtgttaaccccggtgagcaccatcaaactgggcaactacgcggtataacgtcctcgatgtcgatgtccaacttgtcaccggccgccaagggcgcggaaagcgccccgtggccaccgcatcggtcagcaatctgggtgctggcttgcccgccacccgggagggtacaccggtggccgtctgcaggacggccaccatagagctgttaccgggcagcaggcttcgctaggtgaacagaaggggtgcccccatgttggctgccacgcattggacaccgtccaggatggccaacgtgactcagcaagatcgggccaaccggtggttaggcgagtgcccgtggacaacgacgacgggtttgtcctcccaccgtcggagttcacgcagcccgacggcgacaatttcattggtttcattggtcagcgagtcggtgcccacgattagcgtagcgccggcgaacccggcggtaacttcttggctagcaggtggaccgcgctctgggcactggtcaccacgtcagtcaccgatgacggtaaagccgagttcgtgcaggtaaaccgcaacctcatcagcgctacggtacgcgttgcttcagtggcaaacagtggtgtgacttaccacctcacctaacgactgcaccgcaccgtcggtgaactgacggccgagaaacaccgtgccgtccagattgattcagtaaacagccatgtttactgaatcaatatttaaaattgttagtatatcattttttatcagcttgtcattttagcccagctcgcttacccgatcttcggcgtcgatgacatcttcgacagcaacgatcgcggacagtatggaaccagtgcatcgcttcgtcgccgcgaccgggtactagcaacgtgtcggcgtaagcgtagaatgaccgcgaagccgtggtgccgatatggcccgagtccagctacaacatgaacaacaccgtcagcgcttgctcaagctgtccaagaccggctcacgcaccggtgaagatattcaaactcgtcagcgtcatcgtcaccgagctgggcggcgtcgggctcagagctaactcgatcgcctactgtggacggccaaggtcacgtccgcaatcagcaatcaacgcagacttactgcccattctgcgggcagcgtgcaactcggccaatgcatgggcccaaccgccgtactgttaggaggcgatttcgacagccgcgcaaatcgcggcgatcctgctggcgtgggctcgagccggcgggcatggcttagggcggcttccggatcgccgccgggggcagtgccttgcggctggactggacacgtacgatccgggcctgaccgggaaacctcccacctcccgctcgccaggtggtctgccctgctgcacgtcgccggattccgggcacggtcggtcgcgcacccctgcaaccatgcctgttcgccgaccatgcttataattcacctcaaaacgcttctgagattttgccctagaggttatgtgcaaaggctccgcaattacgcatgggttaccaccactgtacacacgcctcgggacagatttgccgctgagcattggtagtcccgctatggttaacctgatttctctacaatcatttacactcacagcctattgagcatgagctgtgcacctttgttgtacaaaagcacataaaaacagtgattgacatgagcttatacctacaacacaacaagatacattttgcacactagcgcgttttggtaccgcgctacgcgcgtgatcactaaaccattatggagccgacggagattatcggttcatactaaaagaaagacagtcaccaattgcaggccggacggccatgggtgtatgtgggaaattctgtgggattgtcctcaatcggatgataaattgatccctcgatgcgggactcgaatttctttctgtaccccagcaatttgtgggatagcagcccagtggaaaaacccgaaaactatgcctcgagaaggacatcagcagaatctctatcccactcaatgtgtcgcgggatagagattggaggcatcgaccactttgatagagtgcgagttcgatattgtgcacacctcccagttgatatatagaacccagcgggggtctcctagccccctcaccccaattttagatgcctccccactgaatctcatctccacgacaacaacgattaatcgctcggagaaactctgtaatcttctaacgcgccaacgccaactcagttaacgtaacttactacttcgaaattccaccgattcgacgccacggagccaatgtggacaaattggctacattggccagcaggggtattggggaatggcgactccacgctaattgcccactgatcgggcacccacagcatcatctccccaagcaaacctggctggccgttcaacttctgctgaaaactgctggcatcaccagcgtctccgactgagcctagctcgacgatctcggaattccctctacgcaagccgtacgacccatctcataccaaaccttgttggtcagtcgttgatatgtgacttagccaacggctgcgttccagtcgtgaaggtcatcgataacgaccctacttaatttaattatcttcgctctcatggctgctccaagtcccgctcgaagagtcgagcatgatcacccagctacagatcatcgtcgcagcgaatcccactgttcaatgtcgccgacatccgagctactgttaccaatcacgaagtggtgacacagattgtgttcggacgagcattgtcgtacagcttgcagcctgacgacaatgctcgtcatcgacaggctcttatctatctcggtagcctatcagtgcggcaaagggaattgctggccctgatcgccggcggagtgggagtggtcgattctgttagcattgggtgtgttacgcaccgctgagttgtatacgtttgggctgcagggctacagcttaagtctacgagggatactatagacaggttgatagaagccgacgacgaggtaggcatgatgcatggagattccgaagacaggtatttaaagtgttagtcgatgcggtggaaatatccgtcgaacagtggcgcagaccgtcaatttctagtattactttcagccctttggccggcaagcttatcgaaatggctcgcaccataccgttcaccatacagacttggaacagtctactagactttgtcggcgccgatatagccgccagcctggccaaccagctacgatcggtgtggggcgacattgaaacacgctgatgcagtgcttgccctgtatgcgatcgtcagtggtcagggggcggtcgcggtgcgaaccggtcacctccgacggtctgatcggaacggtgacgccaacggtgggccccaccaactctcgttgccatagcaacccccgacaggggcgaatcccttgtcgatatcgtcgacgtggatgtctggtcaatgctgaacttatgcacgactgaccggccagcctactcgcctgcgctagagcaggctgctgcttgatactgaccactgaagtaccccgccgacgagcccggcatagttcgctaacgcacttaccaagccgtcaccaaaagataaccgccgaccgctaccaacgtacgctggcaatggttgttcaccaccatgcgctggccaccggcattatcgacgaatctcagctttcccgaaaccgtcagggcgcagtggttcacaaccgagaaaaacatagagcctggccgacgaccccgttgagatctcgacacgactcaaccactcgtaccctcgtgttcatccggtcgcttcccggcatccagcacctcctcaacctgctgggcgactcacctgaaactggcccgaatagcgcgccatgaacacccaggcgccggccattacgcaaccgcctagcttagccataaaccgcatccaacgtgccacaccccggcgctactcaacttcaggcgcctgttcagctcgcgacggggcttagtgtaccaaatagagatggctaagcgtaacctgattaccaagaactggttctacgctgccaccgccccgcccgctgtagctgccgtggacaaccagctgccgaccatccaaatcgggctatctggggcctagtaaactagcgatcacccaacccgtgctatactctttctatcccggcgatgttccgcttgccacggcgcagcaccagccagcggccgtgcaggaaatccgatgtccggggcgtccattcctcgctctggatgcgaatgttgttgaccaacaccccgccttcatcgatagtgcgccgcgccgcacccctgctaggggacagaccgctggccaccaacagatcgacaataccatcgggattgccgggtttcagctcagcgaccactgtctcgcgcaatgccgtcgccaacgtcgcttcgtcaaggcgagcaagttcgccctgaccgaacaatgccctgctggcatgctcaacagcctgggttgccgctgcgccatgcaccaaaaccgtgagctcggtggcgagtcgacgttgtgcagcacgttcctgtgggcgtgagaccgtcgtctgctccagctcgaccagttcttcgggcaacaaaaaagtgaaccaacgcaggtaccgaatgacatcagcgtcggaggtgttgatgaagtattggtaccaggcgtacgggctggtcatctctgggtccaaccataaactgccacctccggtggatttgccgagcttggcgccatcggcagcggtcaccagcgggactgtgagcgcatgcactgtggcgccgagcttttgtcgcaccaggcgaaccccggcgatgatgttgccccactgatccgaaccgccgatctgcagcgcacagccatggcgctgatgcaattcagcataatcgttggcttgcaacagcatgtagctgaactccgtgtaagaaatcccttggccattcaaccgtcgccggattgtgtcccgatctagcatcaagttgatcgaaaagtgtttgccgacatcgcgcaagaactcgatcgccgacatcgggctcgtccattccaggttgttgacaacat

SEQ ID NO: 134 - DNA (genomic), 36241 bp, Mycobacterium leprae; double-stranded, circular
  hypothetical: NO
  anti-sense: NO
aaggaatttcgctaccttaggatggttatagttaccaccgccgtttactggggcttaaattctccgcttcaccctttcgggttaacaggtcctcttaaccttccagcaccgggcaggcgtcagtccgtatacatcgtcttacgacttcgcacggacctgtgtttttagtaaacagtcgcttctcactggtctctgcgaccggatcccgctcccaccgcaagggtgttcacgatattccggccccccttctcccgaagttacggaggcattttgccgagttccttaaccatagttatctcgtacgccttggtatgctctacctgaccacctgtgtcggtttggggtacgggccgcatgtatgctcgctagaggcttttcttggcagcagaggcttaccgaattcgcctcaatcggctatgcatcacctctcaggattcacgaacgacggatttgcctatcgctctccctacgggcttgctccagtattaccactgactggtacggctaccttcctgcgtcaccccatcgcttgactactaccaacgaagttcccacgcagccccgaacctccatagcccccgaaggggatatggtcgatccggttttgggtggtgagtaccgctgattcatcacgggcgcacacacacgggtacgggaatatcaacccgttgtccatcgactacgcctgtcggcctcgccttaggtcccgactcaccctgggcggactggcctggcccaggaacccttggtcttacggcgggcaaggttctcacttgccttatcgctactcatgcctgcattctcacttccccaccctccaccaccggttacccggaggcttcgctgaatgaggaacgctcccctacccacatccaccctagaaggtgaatgtgccgcggcttcggcggtgtgcttgagccccgctacattatcggcgcacaatcacttgaccagtgagctattacgcactctttcaagggtggctgcttctaagccaacctcctggttgtctttgcgactgcacatccttttccacttagcacacgcttaggggccttagccggcgatctgggctgtttccctttcgacgtacggagcttatcccccgccgtctcactgccacgcttttaaaccacggcattcggagtttggctgacgtcagtaacctagtagggcccatcggccatccagtagctctacctccgtggtgaaccacgcaacgctgcacctaaatgcatttcggggagaaccagctatcacggagtttgattggcctttcacccctacccacaactcatcccctcaatcttcaacttaagtgggttcgggcctccacgcggtcttacccgcgcttcaccctggccatgggtagatcactccgcttcgggtccagaacacgccactacacacgctcacacgtgatacgccctattcagactcgctttcgctgcggctaccccacacgggttaacctcgcgacatgtccctgactcgcaggctcattcttcaaaaagcacgccatcaccccacaaagaggctctgacggattgtaggcacacggtttcaggtactatttcactcccctcccggggtacttttcaccattccctcacggtactgatccgctatcggtcatcgagaagtatttaggcttaccgggtggtcccggcagattcacagcagattccacgggcccgctgctactcgggaattgatacaaggcaggtgccaggctttcgcgtactgggctctcaccgtctacggcaggccatcccaggccatttccgctaaccacggcactttctgactacccctcaaccaggtagagttgagacataccaatcccacaacaccgcacacacaacccctacctagttagacatgtgtgcggtttagccatattccacgttcgctcgccactacttgcggaatcacaattgttttcttctcctacgggtactgagatgtttcacttccccgcgttccctcccgaaccctatatattcagatacgggtaacacgacatgactcgtgttgggtttccccattcggaaatcctcggatccacgctcggttgacagctccccgaggcatatcgcagcctcccacgtccttcatcggctctcgatgccaaggcatccaccatgcgcccttaggcacttacttacacacaaaaccaaagaagaaaattacacattttcaatgaatacgccaccactacataactgacaacgcatccatttagatgctcgcaaccactatccaatactcaaacaccacaccccaccaccaaagatgagggacaacacccaatcaagccgagtgttgcctcaggacccaacagtgtgtctggatatttgctgttgcgcacccggctctcatccactacagatgagaacccctgacggcttacaccctaaactatttagagtgtttttcgtggtgctccttagaaaggaggtgatccagccgcaccttccggtacggctaccttgttacgacttcgtcccaatcgccgatcccaccttggacagctccctcccgagggttaggccactggcttcgggtgttaccgactttcatgacgtgacgggcggtgtgtacaaggcccgggaacgtattcaccgcagcgttgctgatctgcgattactagcgactccgacttcacggggtcgagttgcagaccccgatccgaactgagaccggctttaaaaggattcgcttaaccttgcggcatcgcagccctttgtaccggccattgtagcatgtgtgaagccctggacataaggggcatgatgacttgacgtcatccccaccttcctccgagttgaccgcggcagtctctcacgagtccccaccattacgtgctggcaacatgagacaagggttgcgctcgttgcgggacttaacccaacatctcacgacacgagctgacgacagccatgcaccacctgcacacaggccacaagggagtgcctatctctagacgcatcctgtgcatgtcaaacccaggtaaggttcttcgcgttgcatcgaattaatccacatgctccgcgcttgtgcgggcccccgtcaattcctttgagttttagccttgcggccgtactccccaggcggggtacttaatgcgttagctacggcacggatcccaaggaaggaaacccacacctagtacccaccgtttacggcgtggactaccagggtatctaatcctgtttgctccccacgctttcgctcctcagcgtcagttactgcccagagacccgccttcgccactggtgttcctcctgatatctgcgcattccaccgctacaccaggaattccagtctcccctgcagtactccagtctgcccgtatcgcccgcacgctcacagttaagccgtgagatttcacgaacaacgcgacaaaccacctacgagctctttacgcccagtaattccggacaacgctcgcaccctacgtattaccgcggctgctggcacgtagttggccggtgcttcttctccacctaccgtcaatccgagaaaacccagaccttcgtcgatggtgaaagaggtttacaacccgaaagccgtcatcccccacgcggcgtcgctgcatcaggcttgcgcccattgtgcaatattccccactgctgcctcccgtaggagtctgggccgtatctcagtcccagtgtggccgtacaccctctcaggccggctacccgtcgtcgccttggtaggccgtcaccccaccaacaagctgataggccgcgggcccatcctgcaccgcaaaaagctttccaccacaagacatgcgccttgaagtcctatccggtattagacccagtttcccaagcttatccctgaagtgcagggcagattacccacgtgttactcacccgttcgccactcgagtatctctaaaaaagattttttagagacctttccgttcgacttgcatgtgttaagcacgccgccagcgttcgtcctgagccaggatcaaactctccaaacaaaaactccatcaataactagacgaaattttcaatttctagagatacctgacaagacaccaaaactggcatctataaataacataataaactacacctacacacacgaggaatgctagatgtagtcaaaaaatcaacaacaacaaaaccaaacacactattgagttctcaaacaacacttcaagcttacttcccccgcttcggggcaacccagccagattaatacagatccagcagaggagtcaagtcccgggttgactataacatcttaatgcctggtgacagtgtcagcggtactatacgagcagtacctacaagcatactcgctcgatctcggctcctaaattcgccaggttctccacgaacaatggatacccgcgatcgatgtggaaaacgtcgtagacctcggtgtctccatcagcgacaagtcccgcgagtaccaaaccggcaccagcacggatatccgaacaccagaccggcgcgctcgagagttgtggaagaccccgcacaacggcatggtgcccatccgtgcgggcatcggcacccagccggatcatctcttcgacaaagcggaatcgtgcctcaaacacattctccgtaatcatcgacgtgccatcagcgatcgaagtcaaagcgatcgccattggctgcaaatcggtcggaaaaccgggaaatggcaaggtcgccacattgacggccttcgggcgctcgtactgggccacgcgaaagctgtcgtccgtctgggttacggtagcacccgcgtcatgcaacttatgcaacactagctgaaggtgagcaggatcaacgccagtcacagctatgtcgccgcgggtcatggcagcagcaatgccccacgtagcggctacaatccggtctccgatgacgcggtgttcggtcgggtagagccgcgggacgccggtgatcgtcatggtcggcgaacccacgccttcgacctgtgcacccatctggttcaacatcgtgcacaggtcaaccacgtcgggttcccgggctgcattgtgaattgtggtcacaccctcagccacaacagctgccatcaggatgttctcggtagcgcccactgaaggaaactccaactgaatctcagcgccgcgcaatgtttctgcggaagccaccacgcatccgtgctcgatattgcagcgtgctcccagctgccgtagaccagcctgatgcatatctagcggacgcgatccgatagcgtcaccgcccggaagcgcgaccctggcttgtttgcaccggccgaccagcggccccagcacacagaccgaagcccggaactgccgcacggcagcgaagtcagcatcgtacttcggttcatcaggcgaagtgattctggcaacgtcaccatagagttcgacagtggcgcctagaccccgcagcacctccgccatcagtggcacatcgaggatgtcggggcaattggtgatcgtgctggtgccttcggccaacaaagtcgcggccataagcttgaggacgctgttcttggcacctccgacggtgacttcgcctgacaaccggttgccgccggtcaccacgaatcgctctgccacccgggtcagtctagtgaagcggtatcggcttgtcagtcaactagcttggcttctcctcactccgctgagcggagtgaggagaagccaagctagttgactttagtaccgtgtttggtcatggcaatacatctgacccgcatctacacacgcactggcgacaacgggacgacggggttgagcgatttctcacgagtcgcgaaaaccgatctccgcctcgtggcgtacgcggattgcgacgaaaccaactccgcgatcggcgtcgcacttgccctgggaaatcccgaccaaaaaatcactgacgtactgcaacagatccaaaatgacttattcgacgctggcgcagacctgtccacccccatgcaagactcggtgagaaatcccgaatatccccagctaaggatcacccagacacacattgatcggcttgaagagtggtgcgacacatacaacacaccgttaccaacactgaactcatttgtgctaccaggtggttcgccgttgtcagcgctactacacgtcgctcgtaccgtggcgcgtcgagccgaacgatcagcgtgggcagctgtcgaagctcacccgggggtggtcagtatgttacccgcgaaatacctgaaccgactctcagatctgctctttatcctgtcacgggtggctaatacaggcaatgatgtgctgtggcgaccaggcggctgatggcaaaagctgtagtaacacaggagaattaccatgaaaaacaatcgtccgattcttccggcgaccgttatgccgcactcgcctacccggacacacacactgcgatacagtaactcaccacagccttcgacttcgtcgagtgaacgtggatcgacgagaaccaccgagcacagctgaacatcgtcgcagacggagcaaggatcgtcgccgatatgcgggacgagaaacaaccattcgaagctaacacggcgggaaacgtcatgacggtccgggtcaatgacgtgggcacccagtttgagcggacagtggtggccggagtcagggtactagagtcctccaccgaccacgtttacggcgaacgagaatagcattgtcgaggatctcaacgactatcgctgacaattaggcgaaacagcgcgggatgtgccagcccgaagagtactgataccagaccgtcgcgccttgttatacccgttcgagtacttaatttttccggatgggctgcttcagacgctgcgacgccgtgtgcgcggtgaaggtcgggactccagccacgacaagaacgcagccagtgcaccctgatcaagggcgatctcgtatcctgacctgcgatcctgcgtcgtatcgcgcagttccaacacgacgatcttgtcggtcataatatcgaactcatcgccacgcgggccacgccgagccacaatctcaacaccccgtcggctcaatcggcgatctggccacaaccgcagactggacagccggtaaaaggcggctgcctcaccccgataacggatcacgccatggcgccagccatggcctccgaccgccgggatgtctcgcatgatcccagccgtaccgccctggcgcagtttccataaccgatagctcagggcaagaaccgctgcgcccaacgtgacgacgagcacgaccatgccgaccatgggcgcgctcatcgatagttagtcgatcgcgccgacggcgcgcaatcgggcgcgacccctggcagcgatacgtgggtcgtcagactcagcatcctgcttggcagcattttcgtcgatctccgaatcgaattcggcggattcggcgagaatgctgaccctttcctcggtcaccgacaaaaaaccgccgtccactgccacccgcaggtctttttcgccttcccgttcgatgcgcaccatgttgtcgtcgaccaattgagccaccatggggatatggcgaggcaggatgccgatctcgccggcggtggtgcgggtgaacaaaaaggtgcccttgcccgaccagatctttcggtcaacagcaacgatctcgatgttcaattcgtccatacataacacctttcgctgttagctggaccgggtcacaacttggcgccgaggctctcggccttcttggtcaagtcgtcgagaccaccaatcaagaagaaggcctgctcgggcacatggtcgaactctcccttgcacaagcggtcgaacgcgtcgatggtctccttcaccggaactgtcgaacccggctgcccagtgaattgttcagccgccatcatgttctgagagagaaaccgctcgatgcgccgagctcggttgaccaattgcttgtcctcttcagaaagttcgtcgatgccaaggatcgcaatgatatcctggaggtctttgtatcgctgcaaaatccggatgacttcctgggccacacggtagtgctcttcaccaacaataccggggtcgagaatggtagagctcgacgccagcgggtccactgcagggaagatgcccttggcaaacaccgaacgcgacagctcagtagtggcgtccaggtgcgcgaacgtcgttgccggcgccgggtcagtgtagtcatcggcaggcacatagacggcctgcatcgaggtgatcgaccggcctcgtgtcgaggtgatgcgttcctgcagctcacccatctcgtcagccagcgtgggctggtaccctaccgccgacggcatacgaccgagcagcgtcgacacttcggatccagcctgggtgaatcggaagatgttgtcgatgaacagcagaacatcctggctcgcctcgtcgcgaaaccactccgccatcgtcagcgcggacagtgccacccgcatacgggtgccgggaggctcatccatctggccgaacaccagggcggtgtccttgagcacgttgacttcctgaagctcgacccacaggtcattgccttcgcgagtacgctccccaactccggcgaacaccgatgtaccaccgaaattacgggcgatgcggttgatcatctcctggattagcactgtcttgcccacaccagcaccgccaaacaaggcgatcttgccgccacgcacatacggagtcagcaaatccacgaccttcaggccggtctcgagcatctcagtacgaggctcaagctcctcgaaggaaggcggcttgcggtgaatcgaccagtgctcgaactcgtctccgtacccgggctcatccaggcagtaccccagcgcgttgaagacatgacccttgacgccctcgccaaccggcaccgagatcgagttaccagtgtcggttacctcaactccgcgcaccagcccgtcggtaggctgcaacgagatggtgcgcactaaattgtcgccgagatgctgcgcaacctcaagcgtgagggtcttggcaagcgaggagaaggtggtcttcgcatttagcgcgttgaacaactccgggacaaaaccgtgcgggaattcgacgtcgacgacaggaccagtaacccgtaccacgcgaccgctggtccccttgcttccagtctttacagtcattttcgtcgtcttagtagtagacatattctcttcgtttccttgtgggctacctagcgggcattggcgagtgcatttgctccgcctacgatttcgcttatctcttgggtaatctgggcctgtcgctcacggtttgcctccaacgtcagagccttgatcaaatcgtccgcgttgtcggttgccgatttcatcgcccgttggcgcgacgccagctccgatgctgcggattcaagcatcgcggcgtacacgcggatagtcaggtaccgcggtagcaacgcttcgaacagtgtcgtagcatctggctcaaacgagtacagagtgcgcggaagcttggactcctcgacatattccacgaccatcggagccatccgacgggccttggtcgactgcgacagcatcgatttaaattcggtgaagacgatgtgtagctcatcgacacctgcatcgctctcgctgcttccgagcatgaatacatcgaccagcgtcgaagcgattttggcggcgttctcatatttgggttgttcagaaaagccagtccacgactcggcgatgccccagttgcggaaagtgtagtaattcagcgctttacggccgaccacgtacagtatcggtgtcttgccttccgcccgcagcagcgaaaacaactcctcagagcggcggaagacgttggcgttgtaagcgccacacagaccacggtcggaggacaccaccaacacgccggcacgcttgggtgtggcactcgcgacgagcaatggatggtcaagaaccgcctcataagccagggtagtgagcattcgagtgatatcgacagcgtagggtcgggcggactccaggcgaacttgcgctctggcgatacgcgacgtcgcaatcagctcctgggccttggtgatcttcttgatcgagcccactgaacggatccgtccgcgtagttcgcgaagtgtggcagccatatctccattaccctctattacctgggtgtgctatttttgcttttctccgaagtctttgctggaatagcctggtgcactttcactgattccttgtccaacttctcctcatcgagggctgcgacgtgctcgttgggcaccaccgatgcaccaccagtcgccgcgaaacccttcttgaagctcttgatgacttcagtgagtgaatcggcggcttcgtcggtgagcttctggctctcccgaatctcagtcaaaatttcctcttgtgcaacccggatgtggtccagcagctcggtttcgaaccgcctgacatccccgaccggcactgagtccaggtggccgccagtacccaaaaagagggatatcacttgctcctcgacgggcatgggctggtactgcggttgtttgagcaattcgaccagccgcgcaccacgctccaactgtgccttggaggtggcatccaggtccgaggcaaaggcagcgaaagcctctagctcacgatactgcgacaagtccagacgcagcgagccggccacttccttcatggccttgatctgtgcagcaccgccgacccgggacaccgagacaccgacgttaatggccggccggaccccctggttgaacagatcggtctctaggaagcactgcccgtcggtgattgagatgacattggtagggatgtaggccgaaatgtcattggccttggtttcgatgatcggcaaacccgtcagcgagccgccaccgaggtggtcagcaagctttgcgcaccgctccaacaaccgcgagtgcaagtagaacacgtcaccaggataagcttcgcgacccggcgggcgacgcaacagcaaggagatagcgcggtatgcctcggcctgcttggtaaggtcgtcgaagacgatcagcacatgcttaccgtcgtacatccagtgctgagcgatcgccgaaccagtatacggcgcaagccacttgaagccagcggaatctgatgccagcgccgcaacgatggtggtatagtccatcgctccgccctcctccagagcgcggcggacagaagcgatggtggtacctttctgcccgatggccacgtacacacaacgcacctgccgcttgggatcgccgctctcccagttctggcgctggttgaggatggtgtcaacacacaccgcagtcttgccagtcttgcggtcgccgatgaccaactgacgctgtccgcgaccgatcggagtcatcgcgtcgatggccttgatcccagtttgcagcggctctttcacgctttgccgctggactaccgagggcgcctgaagttccagcgcacgccgagcctcggcctcgatatctccgcgcccgtcgatcggctgaccaagcggattgaccacccgccccatgaacgcttcccctacggggaccgagagaacgtcgccggtacgcttgaccttttggccttctttgatgttttcgaagtcaccaagtatcaccgcgccaacgttatgttcgtcgaggttgagtgcgacacccaggatcccaccggggaactcgagcagctcctgggtcatcacggagggcaaaccctcgacgtgcgcgatgctgtccccgacgtcgacaacggtaccgacttcctcgcggaacgtgtcggcggtgaaggagcttacgtactcttcgatcgcgttctgaatgtcgtcagcggagattgtcaactcggccatggctttttcgtcttcctacttgattttcgtctttcgcgcggatttagtgactagttcgtgttcagtcgggcaacgcagcctcagcggcgaccagacaagacgagagagtaccgtcgatcacctcatcacccaccacgattgagagcccacccagcagtgcagcgtcgatttgcatctgcacggtcacgggatggccatagatgcgactgagcacttcggtaagccgcgtgcgctgggcatcgctgatctcggccgccgcactgacttgcgctacgacttcaccacgccgagccacggcaacttcggccaaaaacagtatggcttccttggccggctgacctcttaataactcgactgtctgggacaacagggcgaccgcgatcggattgaccacgctactcgcgctctgcagcacattgcacagcaaccgaacccgactgtcggctggcaccgcgtagtcatccaacaagatggcaagtcgcggcgcaacgtcgagaatgcgagaaaaccggaacacctggtcttcgacctcgtcgatctggtcctcacgttcggcgacttccaatagcgcttggcgcgagatgtgctcgagggcatcgaccaggtcggtattggccgaccaacgctccgatacggccgcccgcagtatctccatcgtcgggtcgccgacatgggcggataccaatcggtcgatcaacttgacccggggcgcctcatcctcgacgggcacggtgagataccgagtcaccacgatttcgcggtccagcattttggcaaccgacaccagttcgccggcaagagtatatagcgcttgattgtccagactcttggcgatggcaccgaaccgatccgccaagtcgaccagcgcccgccgactggccgaacgcattttcgccaacaacggatactcaacgtcggcgcccttgggagtcatggcatcgaggtcatcgagaaagcgatcaacagtggctgactgctgcaccgcatcggcaacgtgattgcgcaccaattctgctgcctggcgcacagattcgtggccaaacttcaggcgaagctgacgggtcaactgggcccgtagcagttcgacttggcgagctccctgtagcttgatgcgttccgcctcgacatcggcctgggcttgcaattgctcaacaatgcgcttggcgtcttcgacagcctctttgacgacacgctgggcctcgaccttggcgtcttcggtggccttggtatgggcctggctcgcttcaactagccgatctgcggcctcggccgcctcagtcaactgctggcgcaccgcgtcccgccgagctctcatcaaacggcacaccggcggcactacataccaccacaccaaatagacgatggcagcgaagccaaccaactgaccaatgaatgttgacattgacgctatctcgtcacaacggaagcggtgatgtcaacgcccaggattcgactggccaggatcagcgacatggcgcctgctttggcgcgcagatccagttccaccgcatctcgttcccgctttatttgctcacctgcaatttgcaacgtcgacactacgtgctgctcagcgcggacacgcgcttcttcgatggacttacggccgtctactcgggcattgtctcgcaaaaacgacgactggactcgcgcttccttcatggctgcttcgtagtcagcctgggcggcagcgaattgcgcggccgacatcttgctgtcagcatcagttttggcgaccatggcgtcgcgttcctgcagtaccttcaggatcggcggcacgacgaaagtgccgatcacgccaagcaccactaggaaaatggccagcacgaagaagaaggtgccgttcgggaggaggaagttgctacttttgccttcctctgctgcctgactgacggcaaaaacgatcgcgctcacttcaaacattgacaacccatcataaccaaattatttgacgggtgtggcgaagacgaacaacgccataaacgctaggttgatgaagtaggctgcctcaaccaagccaacggtgatgaagaacggtgtgaacaagcggctttgcgcctcaggttgccgggcaatacccgaaaccagcgcattgcctgccataccgtcaccgataccggcgccgattgcaccaccagccatgatcaggccaccaccgataagtgcaccctgagcgatcatgggatccatactttgtcctccttatacctcaatagctactatctgtgtagcggtctacctggcttgaagtagtggcttgtgggccaggataatgcgtggcgtttttagtcatgatggtcctcaacctccatggcttggctgaaatacaagatggtcagaattgagaaaatgaatgcctgaatggcgcccacgaacaggtcgaaagacttccagatcgcattcggcgcccacataatgtacggagggaacagtgcgatcagggtaaccaggatcccgccggcgaagatattgccgaaaagtcgaagcgacaacgaaatgggctttgtgatttcttcaaccaggttaatcggcgccaagaacgccacgtgacctttgagcaccgccaccggatgcccgacaatgccgcgacgccagatacccgccaagtgatagcagacgaagacgaaaaacgccagcgccagcacgtaattgatgtcggccgccgccgaactgagcacctcggtggtgtgcccatctgcgttggtgtattgcagcggcagcaccgagagccagttggagatcaggatgaacacgaagatcgtgaccgccaacggcagcacgaacggggcaatccgcatgccgatagcgctctcgatctgagtgcgcatctgtaccgtgatcgcctcccagaacaactgcatgccacaaggaacacctgttgagttgaccttggtacgcaagaagaaagccagcgcgattacgatcgccgccgcgatcgcagtggagagcaccgtatcggtgttgacggtcatcccaaaccaggtggtggtgtggtgctcgccgacctcgatttgacctccggataggattgtctcagtcatcgctgctgctcctcaccttctgatcctttgagtacaccgccgtccgcttccccgaagcggaacttcctccagaccggcagcatggtcgataacaccaatagcacctgaaacagcgccaacccgaacaccacgcctaagccagccaggggaaaagcgtacgcgatgatcaacccaaagacagtgatgatcgccaaccgtgacgcagagttaagcgccattgatcttttcaacggatggccttgagccgtgatcgactcgactgaacaccgtaccaagagagcgttgagcaaacctaataaaagcccaataccaaaaaagacgccgaccattagatgaccggacaaaccagcggcgagcatcgctaacccggttaagacaatgttgatgataaaaagccgaaccggacggaaagcaacagcgggcaacaccaacggggcgtcctgcgctggtgtcgtcactgcgctacctcaatcccgggttgatagaatcgtaaccactcaaccaaccgatcggtggcccgcagagcgtatcgcagccgtcgtgctggaaattacccaaggggttgctccctgtgtcggtagtacagcggcacgctcgaacaggaatccaataacccggaaacgggaacccgagaaatttatttcggggctctggcagcagtgtaccacactaatagacatcactactactatcggtagtaaaagcctcctaggcatggtcctaatagttgtcgcgacggcgcaacagcgggatcaccgtcgccatgccagtgatcacaattgcgcccaacatgaccgctccggtgttacgcgggttgaagaaaatcgtgcttgccgcaccgaatgcgacgatgcccacccaaaggtagatcagcagcaccacacgacgatgcgagtgtccgatctgcagcagccgatggtgcaaatgcatcttgtcggggctaaaggcgctacgacccgcgcgaatacgacgcacgatcgctagcagcaagtcgagcataggcacaaacatgaccgccaccaccagcaggaacggtgacagcagagcaaacacatcgcgagtgccgtaagcgttctgcgagatcggtccagcagcggtcgtagaggccgccgcaagcattaagcctaccaacatcgacccggaatcacccatgaagatcttggcccggtgaaagttgtgcggcaggaaacccagacaggatcccgcaagtaccaccgaaatcaccgccggcggataaaacaacacgtcaccatcatggtcacgaagcaagccaaccgagaatatgcagattgccatcgcggtaatgagccccaacccggcggccagtccgtcgagtccgtcgacgaagttaatcgcgttaacgatcgacacggtcaacgccaaggtaagcaaaatcgaggaggtctggtccaacacgatagtgccgacgccacccagcgggatatagaggacactccaagcaactcccatggtgaccagcacgctggctgcggtgatctgacccgcaaacttcgtcagtgcgtccagaccccagcggtcgtcgatcagtccgatacccgtgatcaccgcaccagccaccaataccgcgggcatgcccgaggaatagacgaacccgcgggtaagcgccggaagctgagaagccagaaagacagcagccaaaacgccgagatacatggccagcccacccatccgtggggttggcgtcacatgaacatcgcgttcgcgaggataagcgaccgcttccaagcggttggctaacacccctaccagcccagttgcgaagtaagtgatgatcgcggcggtcagtccgaccaatgcaagctcgcgcagcgggacaccagcactacgctcaaacaaggcgagcaaaccactggcaaaggtggctaggtcgctggacatctcgcgaacgtactgcaccaacctgagacccgcctaaccgcgctggccagtttaggcgatcagactcgcgggaaccacccctagcacctccgcgatccgcgcaacgctcactgggccggctcgcaggatccgcggggttgcttcggtcaagtcgacgatagtcgaggcggcctgctgcgcggacggaccggcatccagatagaccccgaccagctctccgagttgaccccgcgccccgtcgacgtcgaccgctgccggctgaccggagacgttggcactggaaaccgccatcgggccaacctcacacaataattcgatggcaaccgagtgcaacggcattcgcagcatcacggtgccgtgcgcatcgccgagatcccaattcaacgatggcgcgtgcaccactaccagactcagcgcacccggccagaatgcgcggatcagctcacgggccccgtcaggcatcgtatagaccagaccttcaatggtgtgccaggagcccaccaggacacccaccggcatgtcacgtcctcgtcccttcgccgacagcagtgcggccactgcggcgcggtcgaaggcgtcagcgccgatgccgtagacagtgtccgtcggcatgacaaccagtcgaccacccttgagcgccgcgaccgccgaagcgatcccacgcgcacgctggtctgggtcagcacaatcgaacacctcattcatgcgtaccacttctcctcatccctacgctctgcatcgtcgcgacgcaattcatgcgctccagctttcccgcctgcgggccgtcacaaaccttggccgaccggctagatctctgtgggtcaagacatcgtcgaaaagatctgttcggtagaccaagtcaagcgttggcaccgacgtgctgtcgtcatgctcgacggcgaataaaccaccagggcgcagccaacgcccggctagaccgacaatgtcagccgtcagcgccattccgtccggaccgccaaataccgcgtgacgcggatcatattgggtcacttcaggttccagaatggattgcactactggatcgtcaggaacgtagggtgggttgggccacaaagagatcgacgcatccatcaagttcaggcaacagagccggggtggtgacatcggcacgcacgcattctactgcggtgccttcagcattgcggcgtgcgtagtccagggccgaatcggaatcgtcgatgccaatcactcgtgccgcaggccgatggtgagccagcgcgaccgctaaagcgccggatccagtacacgcatccacaatcactggccgctccggcagccgctgtgccatcacccacgccaatatggcctcggtctctgggcgcggtatgaatacatccgggccgacatgcagcactactggcccgaacgacaccgtaccgatgagatgctgcaacggcacccgccgcgaccgcgcggcaacggcgtcgctgtaacgcctgaaaaactcctccccgggcgtgtcaagtaaggccagccgaccgcggtcggtgccagccaggtgagcggccagctgctcggcatcgcaacgcgcagaaccgatccccgcttcctcgagctgcgtcacagcagaatcaatcgcacgccgcagccgaatcatcatacctgttgcaaccttgactgcttatcagcagcacttaacgcgtcaaaaagcgcatccaggtcaccgtctaggacctgatcgagattgtgtgccttgtaaccgattcggtgatccgtgatccggttctccgggaagttgtaggtgcgaatgcgttcactacggtccaccgtgcgaatctggctggcccgatccgccgacgcgttggctagtgcttgctcctcggccattgcctgcaggcgggcggccaacacctgcaacgcacgtgtcttgttctgcagctgcgaccgttcgttttgacaggtgacaacaaccccggtaggtagatgagtgatccgcaccgcggaatcggttgtattaacgccttggccgcctttgcctgaagaccggtagacatcgatgcgcagatccgactcgtcgatgtgcacttcacctatttcctcgggttccggatagaccagcacgcccgctgccgaagtatgcacacggccttgggattccgttaccggtacccgttgcacccggtgcaccccgccttcgaacttcattcgcgaccacaccccgtcgacagcgtcaccatcactggcacccttatgagaaatcgctaacgtcgcgtccttatagccgcccagatccgaggtggtttcgtccagcaccgtcaccgtccaaccgtgccgttcggcgtagcggatgtacatcctcgcaaggtcagcagcgaacaaggccgactcttcaccaccctcgccggatttcacttcaagcactatgtcgtcggggccatgcgggtcatgtggcgccagcatgtcagtgagttgggtagttagttcggctatccgtgattccagttcggcgatctcgtcagcgaacgactcatcgccggcggcgagttcacgtgcggtctgcaaatcgtcgcgcgccgatatcagcttgcggtgcgtggccacgatcggggccaatcgggcgaaccgacgtccggctttgcgcgcctcggcgggattgctgtgcagttccgggtctgccaatgcaagctcaagttcagcgtgttcgataagcaacacgtcgatcgattgcaccggctgcgcatatcaactcctaccgcaaactgctaccaccaaacacgaaacgacacccggcctgtgcaggttcacgcacagttcggacggcagtgagccagctatttattgttctgctccgggtacgcagccacctggtccaccccaaccttgcgtttgccatagcgcttttcgaagcgggcaacccggccgccgctgtccaaaatcttctgcttgcccgtgtagaacgggtggcactgcgagcaaacctcgaccacaatgcggcctcccggcttggtgctgcgtgtttggaaggtgttgccgcatccgcagaccacggtggtctccgcgtaggcgggatgaatattagctttcatagtatccctatttggtcgtctaccgccctggtccccgtgtcgatccggcagccaggcaggaactccgaaaaccggaggtggttcggtagtggtcgaccgccaattatgccaggtcaaccgccaccaccccaaacacccagatgcgcccgtgcattcccgaccaattggccaagatgacccggctgtaccaaccctacgacaatcgcgacttcaccaagtagccgccaaggagacgcccgtcaggtcgtgtcgcgtacgtagtggctgtgtcgcgccattgctcgccgtacttcaccagcggcttaggccgctaatcatcgtccatggaacctggcgtagtcttggatacctgcaccaggaactcgtaatttgtcttggtcttgcgtaactgcgacatcaacaagtcgatggcctggtgggaatccagacccgacaacacacggcgcagcttgtgcacgatgccgaactcgtcaggcgacagcaacaactcgtctttgcgagtaccggaggggttgacgtccacagcggggaaaacccgtcgctcagcaatcttgcggtccagcttcagttcagcgttaccggtacctttgaactcctcaaagataaccatgtctccggtggacccggtctcgaccatcgcggtggcaatgatggtcagcgacccaccttcctcgatgttgcgagcggcgccgaggaatcgcttaggcgggtaaagcgcggtggaatcgacaccaccggagaggatgcgacccgaggccggcgacgcgttgttataggcgcgccccaggcgagtgatcgagtcgagcaagacgacgacgtctttgccctgctcgacgagccgcttggcgcgttcaatagccagctcggcgaccgaagtgtgatccgacggcggccgatcgaatgtcgaagcgatgacctcgcccttgactgaacgctgcatgtcggtgacctcttcaggtcgctcgtcgaccagcacgaccatcagatgacattccagattgttcctggtgatcgcgttagcgatgtcctgcaggatcgtggtcttaccagccttgggcggcgacacgatcaacgcgcgttggcccttgccgatcggcatgatcaagtctataactctggtggtcaaccgatcgggcgtggtttccagacgaagccgctgattggggtacaacggtgtcagtttgccgaactcgggccgcttcttagcatcttcaaccgatccaccgttaatactgtccagacgcaccagcgggttgaacttctggcgctggtggccctgctcaccttctcggggcacccgaacagctccggtcactgcgtcaccccgacgcaagccgttcttgcgcaccatactcatagacacatagacatcgtgcggaccagccagataaccagaggtacgaacgaacgcgtaattgtcgagaacatcaaggataccggcgaccggctggacgacgtcgtcctgacgcaattcggcctcggcaccgtcaccggaccgctcaccgcgccgcctgcgatcgcgatcacgaaaccggcgtccgcgcctgccctggcggccctcgccgtcgtcgtcaccgcgcggctgcaaactcgaactctgctgttcaacaccctgatcgttacccacatctggtccgcgctcttcggtcttggtgtccgattggcccccttggagggtgcgagtgtcatcatcagcagtgccctgacaatccgactccgtggcctctgctgtgctagtgccggccgtgacatccgcttcacgagaagcgccgcgtcgttcccggcgggacacctcgactatcgcatagttctgttcctcttgggcagccagtgcttcggtgctgatggctgttgcagatccaccgtggtctcgcgatgggccatcgttgaccgacgtgccgttggcttgccccctgcattcctcaattgcggcgattagttcgctcttacgcatgcccgacgtgcccttaacaccggcttgattagccagcgcccgcagttcaggcagcaccatcgtggacagcgatcccagtgacacggtggccgcagtggctttgacatcgggagtgtctgtagtcacggcgttcgtcagctctgtgtcatcagtgttttcgccaaccgtgataaggtccgtttcagtcacggatttcctttcttccctcgctgatcacgtcatgcgaggagtcgttgcattcagccaaagtgctgagcgcgcccaatcatcgactctaattaacggtgatcgccaagatcggcggccgaaacggcgaacctcgtccacgaaaagaatttgatgttgtcctagcgtcaacacagtatgaatgcacatgcagatgctgcaattgctggacaggttcaaggatagcccgcttccttgccggaagcaagcaaacccgccggcaacggtgtgaattaaccgggaactgtgacctctggccgccagcacacttcatccccggcggtcatcttgatgatgataaatccgtttgcggcgccgtactctgccgcttcccggggcaactccgactgtgtgctcaaggcaattagggatggacccgctccagaaagcgtcgctgccacgttatgacgccgcaacagtcgcaaatattccgccgaagccgacatcgccgaggcgcggtgcggctggtgaagcacgtcttctgtcgcggccatcagaagatcaggccgttcagtaagtgctaccaccaacaacgcggcacgactcacattgaatctcgcgtcgtcgtggctaacccgggcaggcaacagcacccgactctccgcggttgaagaacgttcctcgggaatagcggcgaagagatggatatcgggatgaagccgcagcggtaccgcgcagtagtcaggctgatcataactgcggtcaacccacgaaaccaccgcaccgcccaacaccgcagccgccgcgttgtcgggatgaccctcgaactccgacgcaagctggattagctgagcgttgcttagcggtgtcgaatcaatctgggcaacaaagccgttcaccactgctaggccaccgaccacagccgccgcggaggagccgagaccacgggagtgggggatagcgttgcggcagcgcactaccaggccagccgcactcaccccaacagcctgcaggccgcgtcggacggcacgcactaccagatgttcagggcccatcggcacctggtcggctccctcgccatcgacgacaacaaccaagccggaatctgttgtctcgaccacaatctcgtcacaaagactcaatgccagaccgatgctatcgaaacccggaccgaggttagcgctagacgccgccaccacggcgctggccaccagaccagcaggcagcatccaggtcaccaacagcctttcactgagcccaacgagtggcgccccaccgcacccaactgcgtcgcacttgcgatcaccactagaccagccctaactgctcgacaacagcgaccgcatcgacaggcactggggagacgctcggcatatccttcaacgccgtgtcgggatccttcagaccgttgccggttatcgtacacaccaccgttgacccacgagccacccagccaccatcgatggccttgaggaggccggcgatgctggccgccgatgcgggttcgacgaagacgccttcagcacgtgccaccagatggtatgcagccagaatctcctcatccgtcgcggccaggaatcgtcccttggattgctgctgggcttcgacagccgacgtccatgacgccggcgagccaatgcggatcgcagtagcgatggtttcgggatggctcacaggctcgccgagtaccaggggagccgcgcccgcggcctgagtacccaacatcctaggcagtctgtcgatcagaccatcagcgtgatattcggtgtatcctttccagtacgcagtgatgttcccagcgttgccgaccggaagggcatgcacgtgtggtgcggtgcctagcgcgtcaacgatctcgaacaccgctgtcttttgaccttcgattcgcaccgggttaaccgagttgaccaacgagatcatcgggaaatcagcagccattttacgagccagttccaggcaatcgtcgaagttgccgtcgatctgaatgatcttggctccatgcatgaccgcctgtgcgagcttgcccatcgcaattttaccctgcggaattagcaccgcacaggtaataccggcgcgggcagcgtatgccgccgccgacgccgaggtgtttcccgtcgacgcgcataacacggcacgttgcccgcgggccagtgcatcggtcaccgccatcgtcatgcccctgtctttgaaggagccggtggggttgaggccctctaccttgaggtgaatcgtgcagccagtctgttcggagagtctgggcgcagcaatgagcggcgtgccaccttctagcaaggtaaccggggtccaatcgtcgcccactggtagtcggtctcggtacgctgcgatcacacccggccaaggctggtgggtggtcgtctgctggccgctcacaggctgattccttccagtcgcaacacacttgtgacaccctgcacgacgtctaagtcagccaacgcatcgacggtttcggagagcgcggcgtcggtggcgccatgagtgaccactacaatacgggctcccacccgtcgtccgccgtcatccaccacaccttcttgacgaacttcggcgatgctcacttcgcgcttggcgaattctgctgctacccctgataatacaccaggcttgtcggctacattcatgctcacgtaatatcgagtagaaatgaaacctattgtttccataggcaattgagcatacttggattcttttggaccgcgactgccgagcactcggttgcgcgccgccattaccaagtcaccagtcaccgccgacgcggtaggagcaccaccggcgccctggccgtagaacatcagccgcccggcggcctcagcctccaccaccacggcgttgaacgctccgctgaccgtggcaagcggatgtgacatggggaccaatgcaggataaacgcgggccgaaactcgttgctggccatcggcggcggtaatgcgctcgcaaatgaacagcagcttaatggtgcaacctaacgcccgcgccgacacgaagtcggccggagtgatcttggtgatgccctcgcgatagacatcatcggcggttacccgagtgtggaaagcgatcgatgccaggatcgcggccttagccgcagcgtcatggccttcgacgtccgcggtgggatcggcttcggcgtagccgagcgctctcgcaccggccagcgcgctgtcgtagtcggcaccggtgctgtccatcgcagacaagatgtagttggtggtaccgttcacaataccagccacccgcagcacggtgtcaccggccagtgactgggttaatgggcggattaccgggatggcacctgctactgcagcttcaaaatacaagtcgacatgcgcactttcggcagcctgcgccaattcaccagtggaggcggcaagcaacgccttgttcgccgtgacgacagacttgccatgttcgagcgctgacaagatcgccttgcgagacagctcaactggtcccatcacttcaacgacaatgtcgacgtccgcacgggagacgagttcttcaatgttgtcggtcaacaaatcgaccggaacaccccggtcgacggcgacacgacgcaccccgatgccacgcagcatcaatggagcgccgatacgagccgcgaggtcgtcagcgctgccctcgataatgcgaacaacttcgctgccgacattgcccaacccgagtaccgctacaccgaccgtcctttcatcactgaacacaggtcacctcacttccagactcagcagatcgtcaaccgtctcccggcgcaggatcagacgagcttgccccgcgcacaccgcaaccacagcggggcggccgagcatgttgtaacgacttgacaacgaatagcagtaggccccggttgcggccaccccaaccaggtcgccgggtttcaagtcgtcaggaacccaggtgtcacgtacaacgatatcgccactttcgcaatgctttccgacgatgctggcaggtgccgctggcgcatcgctagttctcgagacaagtcggacgtcatattgcgcgtcgtaaagcgctgtgcggatgttgtcgctcatccccccatcgatgctgacgtagcgccggtgcgcggtagcactcacgtcgacgtccttaatagtgccgacctcatacaacgtgatggtgcccggtccggcgatggcgcgtccgggttcgaccatcaacttaggcaccggcagccccacggcggctgactcgttgctcacgatagcgcccagcttggccgccagctcgaatatcggcggtgggtcgtcatccggcaagtacgagatccccaggccaccaccgaggtcgacgatcgatagctgggctgtcttctccggatcaaactcgccgacaatatcgcacagtaggccgatgacacggtgtgcagcaagttcgaagccggcgacatcgaagatctgcgaaccgatgtggctgtgcagcccaaccagtcgcagattatcggttgcgaatacccggcggaccgcagccatcgccgcaccgctggcaaccgacagcccgaatttttgatcttcatgtgcagtggcgatgaactcatgagtgtgcgcctctacaccgacagtcaggcgcaccaagacatcttggacgatgcccgcttcgcccgcgatggcatcgaggcgctcgatttcggtcgtcgagtctaaaacgatatagcccactccggctttgactgcatctttcaactctgctaccgatttgttgttaccgtgcaagctaatacgctctggtggaaaagaagcatgcagcgcaacggccaactcaccgccgctgcacacgtcgagagaaagaccttcttcgtcgatccaccgagctatctcggtacacaagaaggccttggcggcatagtgcacattttccccaccgccgaatgcagccgctatctcccggcaacggaaacggaagtcgtcttcgtcgatgacaaacaacggagtcccatactccccggcaaggtcggtcagtttatttcccgcaatgcaagcaactccggtttcatctcgagtaatgttacgcggccagacatttgacgctaatcgcaacaggtcatctgagggttgcacacgctgtggagtcgcggtgtgacgggttttttcagcgtgccgaggaccggcggtatgtacgttcacatccgctccggagcactgactccgaggatcgccagcccgttggcaataacctgacgattggcctggcacagggccaaacgcgcggtgtgcaggtcggtaggcttctcgtcgccttggggcaatacccggcaggagtcatagaaccggtggtaatctccggcgaggtcttccaaataacggcatacacggtgtggttcacgcagtgcagcagcggttttgagcacctgggggaattcaccgacggtacgtaatagtgcaccttccttgtcgtgactgagcagctcgaggtgtccggtgtcgggaatcagtccgaattcggcagcgttacgagccaatgccgataggcgggcatgcgcgtattgcacataataaacagggttttcattcgaggacgaggaccacagtgccaagtcaatgtcaatcggagtgtccaccgacgagcggatcaggctgtagcgcgcggcgtcgacaccaatcgcctcgaccaggtcgtcgagcgtaatcacgttgcctgagcgcttactcatccggaccagctgtccatcgcaaaccaggttcaccatctgtccgatgagcacctcgacgatggccgggtcatcgccgaatgcggcggccgcagccttgagccgggcgatatatccgtggtggtcggcaccaagcatgtagatgcacaagtcgaaaccgcgttgccgcttgtccaggtagtaggcaagatcaccggcgatataggccggcttgccgtcgctcttgatcacgacacggtccttgtcgtcaccaaaagcgctggtgcgcaaccagagtgcaccatccttttcgtaaacattaccggtatcgcgcagtctggcgatggcctcatcgacccggccgctggcatgcatcgagtcttcgtgggtgtagacatcgaaatcggtgccgaactcgtgcaacgactttttgatgtgggtgaacatcaagtcgacgccgatttcgcggacggtctcgtgcatctcggattcgggcaggctcagcgcgtagggtgcctgctgcatcacctgcgcggcgatgtcggttacgtaggtgccagcgtagccgtcggccggagtgagctcgcctttggccgcggcgatcaaagagttggtgaaccggtcgacctgggcgccgtggtcgttgaaatagtattcgcgcaccacagcggcaccctgcgtcgacaacaaccgacccagtgcgtccccgacagctgcccaccgagtgccgccgatgtggatcggtccggtcgggttggccgagacgaattctaggttgatctggtaaccagccaggtcatcggagtggccgaagtttttatcggcgttgatgacggtgttgacaatcatggcctgcgccgacgcgtcaagacgcatgttgatgaaacccggtcccgccacctctacgtccgcgatgccgccggcctgcgccagcacctcggcaagccatccggctagttcaagcgggtttgcaccgacttttttgcccagctgcatggccaggttgctggagtaatctccgtgctcaggatttcgcggccgctccacggtgaccgtctgcggcaacgcagcggcatcgagcccgcgctcagccagcaccacaatagcggttgttttgagcagctcagccagatcggcaggggtcacgaatgtccatcctatgggctgtggccataacgcccgaatccgtcgcagtagcagccagcctcgcaatagttcagacggcgtagccgtcagaagtggggacattttaccgcttgcggggacgaactggataatatcgcccagccatcccgatgcgctaatctgctggagcccactggtgcaacatgttatttgtacgcccccgtagctcaggggatagagcatctgcctccggagcagaaggtcgcaggttcgaatcctgccgggggcaccagctttactgcagttcaaaggcgatttttctgccaaactggcgcggcccatcccccaggcatgcctttcggtgcttccttccattgatattagcaaacaccactggaaggaagcaccgatgccaacctcccccgagatcacattccatggaggtggagacgttccagacagaccgcaccaaggcggtggttagtggtggttagtaagctggttttagccgacggtgaagttcgttcgaagtcgaggtgaaccttggctcagtcgcggggactgcctcctcccgcgctacgttacgccgcagaagtaatgacccaggcaacggatagcttgtacagcaccaagtaggtacggttcttatggccgcgagcattattcgtcctaacatgctagcacttcatgagtttgcagccccgaaaggacggctacatcgtccatgtagtcgctgagatccagttgttggctgctacgggcacagttccccggcacgtcggcccggacagcggcgtgctgttcactgcccacatcgatgtaaccacgaaagctgattcaatagacaacgggtctgagaccagcgattggcgcaggtgtaggatttcattgtccgccgaactaacccgcaacacgagcaggcaatcagcgacgcgaaggaccgctactaggcagtggtacgcaaaacgacgcacagcggatgggcatggtttacagcaattacgctggccaccctcaggtaggtactggtgcacgccaacctggtcacgctcgatccaagcgtggtcagatggacacgggtgctattcggcgagttggcaaaggtatatgatgacgagccgcgactatcaacggcgcaccaccgccattggtggacgtgactttgcagccgctgcaccggcccaaggaatacctcgaccattgggccgacaaccgataaaaccgcatgaactggacgagcgaaacgtaaatagagcggcaaacaggcacggccgtcaacaggcgctactggcggccgtgtctgttttgcggcctgatcaatcaggatcgcagacccttctgcacttgaactaggcatacccagccacgaaaaaagacaccgtgaactctcccatgccgctatccaccaccggcgggtggggtaccccgattctggcggggcgcagagtctacgctattggagcggccggacatggaccgaataaattgccgcagccgaccactgtcgtcaaagggctgagccatgcgctgcatgccagcctgacgctgttcacgttcccgttgttcggagggagggacgtaggtgatcatcgcactggaccagtaagaaacacgtccactgcatctaaatggattacgcggactctcctgtttgacctccatgttgaggggcaatgcaaggaccgcctcgctgcgcgtcatagaaaagacgcaccattccggagtcctacctaacctgctggcgctggcttcgcctgcgccagcaggttagggtgtgctagtcgggccccctcggcttcctgttgcacagttcgttatatcgccgctagttgacgcagcccatcagcgatcttcaaccaatcgatttcacccactgcagccaacagcactaacacctcggcgaatccacgtcgtagaatatcaaccagatcgattcccgttgaaacgtaaaaacgccaataccatcgcccacgcggtccgcttgctgcaatccaaaaagacgtggcacaccccagggaatgcagtaaagcggcagctttgtccccacagcttcgggtcagtatcggcgcctaacaagctgacctgcggccgggcaacagcagattgtggcatgccctaatcggccatgattagcggaaaaccaccaggcgaatgccacccaccgactacgatatcgtcctgttccaggtagatttgccatgcaaaccggcggttccgctcggatgatcgagctgtgtgatgtattccaacgtttttcggccaacccggtcagcacgatcactagcaactgacaacatcgcgtcgcagattaacgacttcagcccctgcccattgatgccaggggcagcacacacgacccaagctcggcaccggtaaattggatactcaattctacacagtagatcacgcctccgagagtcggctaacgttaggtatcacgacggtgccaagcatgcggcaggtacgcaatcttgcgcgcaagatctgccaaagcaaacctttgaactagtcaccgtgagcataaacgtcctcgtactggcgttccacccagaagacgtgaaatacgtcattgatgcagacccgaccattggaagcttccagttgtaccgaaacgccaagaatttatcttggttggctaacttcagcgatatcaggggttctgattcggtacgccaatatccgttcggcaccggaaacgtagcgacctgactggtggattctgtatccactgcatctgcgcgcgtttatacaacgtgagagccaactgctcttgacctgtctttgaccccgatgacccttacttcgtaattgttttacaagtaatgcaaacaaaaacacatgatatgtcctggttatagtaacttgactcctaaagcttttggatgatttcgtcattggcctgctggccaccgcgcctcttggtctcttttcgccccaaggcactctcctgatcggcgttatgctgtccgactggctcaaccagtacaacagccgcctccgacgcccacacagctacacttcgccaggttcaccggttataaagcgtcacgctccgacaacatatcgcaggttttcggaccggcagaacctcaccagttcccgccgttactataacgttccgcaccccgtaggccgggaagttcttcaacgcctaaacattccaggtcttcagcgccttccaaggcctttaccctgatttcgaggggctcatcactccctgcaccccacccgcaacgggcaaaacctcgaacctaacgatgccgcagctttgcgtcatgctactgaccactcagtccccctagtaaaaggctttcgacacggggcttcgaccggtccttttccagaccaagtcaccagtctgctaccaggcctcctgacgactacccggaccggacttacaccggcaagcgatgacacgcttataaccaaagagcacctacgctaaggccaccgccgatctgctggtggtcgcgcaaaaaagcaaaactaaattctcgggccgcttttcgtttggggtccttaggggcgccggtgggttggtagtctttttgtggggatcgagggttagctcacgggccaattctcctggtgacggtgtggatgatccggacgtatttaagtcctggacaaggatcaacacacgagtgccagtgtaggctcgatcgacaccgatacagtgcagttgtccgaacacacgcaggttttgccagtaaacacaacacccgaagcaaggccgaccagtacgccaagccaccccgaacaccgtcgcgacggctgctcagcaatcctgccgtggccagctcgacgacgcactgacataggccgagtccactaacctggcgcgggatgacagaactggtaataaacggcactctgaaagatattagcagtttaatcgcctaagttatgataggcatcggtccatatcatcagttcgctcaggcactatagtggggtatgaagcacttgtctgcggtatgctggctaaagctggtatatccagtgctccggcctacatgccgcccagcgccagttcaatcagtaccagtccgccatccctgccgagattgccaacctcgatgtcaacctgctatctgatataccagctgacgccgaagacgccggcaaagagatcgcatggttcgataccgaactctgtggcgagatcgccccagtctcctccgtgctgccacgaacagaatcagcagccgactctacaatcgagaacttggcggcatcataagcgccagatctccaaaactgaaacattggaaaatattaagcactgccatattccactgatcgtcgcaaacaccaaggcaacgcagtcagccatcgacctggccgaccagagcagcgacgaggccgtctggccacgcatgacacactgatgcacgagactgaaccgagtatcgccgaccaatggtgaaccgagcaagtgtggatcggctgtggaaatttcggtccactaaacgctaatttcattgctctgcaacatgtcctggtcatctaagccattgattatctactctgatttgccaaaagcaatgacataaaagtcctttcacaaatcccaattgctcatgcacaattcgaaaccatctaccctgtcctcgacggcaacgggagcaccagcaggtcgttggtccattcgatgttgcgcaacaggcaattaacgcgttaggtcacagtctccgtctcagcgggcctgctatcggacaccaattcgtattttcaggaactaactacttatcgcgagagtgatcccgcaccgatagtcggaaaatgtcggagatatcgtccctggccgtcgtcaatggtcgacacctaatgaatggtttgcaaatgatcaagagaagtggggatcgaaagtcactgcacgccgcaaccctgctgtacgccatgtggcgaattcctaatcaaatgcccagtagtcaaagcacaactggtcaacgatcaactaaacatcgcgatcagcaaccatctaccgatccttggaaccgcttgtcaaggccaagatcatcgtcaaatttaccgacaaggcccgtaaccgatcctagctcacattcgaagtgctcgacgcgctagacgctttcgcagagagtttcagtcatccagcgctgctcacgtgaaattgacggttgtctgtctttctgtttttagcgataaatagatactcgtcgacctggtatcgcgaacagtaaccatccgccgctgaccgccgacagtgatcaccacccgccaccggggcatcacacacgccctccgtttggtcgctgtcctgtcaatgtcttacgggccgggtcactcaggcgacgtggccgaaccatcgggccagggcatggcgaccgttacctcctatagtcttgacgctagtaccgcaaggtagacgtcgcgctggcatcttcgccgccagtgcctcctgcagaagtgaggccgacacctgtgccccggtgccgacgctggagccagtttgagttaccaacgggaccatggaggtggcctcggcagcagtggtgggacgagaggcatcagctggttttcctagtggaacaggaaggcgccgttgatacggtgaggtatcgccggagtcacaaccttggcagtacatcggtcggcactgacggtctcggtggctcggagctcagccaggaaacccaggccctaacggagccgtctgcgcgaacagctgacacggtgagctatcggttggcgaggaatccattttccttccgaggacgatcatgaccactcgttctgcaaagtgcaagcagtctgaaaactgcagcgattgaacagatttagctttcaacccaagttctaagcgtttaccctgttcgtatttatcgttgccgagtgaaaccgaagtgacgatgcacgctttgtggatttgttcgccagaaccacctctttccgtgcggcagcggggtcatcaccacatctaggcgcactccatggagtgcaagcgcttcgggtgataaagccgaaacctgctgataaggtagcactttgaccggaaccagcgatatgcagacgggttaccgcccacggtgtcaccgagccacgtcaaagtacttcggggtagatccgagaaatatggtcgctgcgcggacgctcctgccaggatttccgtacaaatccgaggttgctatatatcgaattgtacttctgtacaaattaattcctactgagagtgcttagccaagcgtgtcaagtgcgacagccagctggttgttctggtaccagaaaaccctcttcggtgcttaccttgttgcacaagacccggtcagtacaacacagtccatatcgctgactataagttgatatctgctgcggcgacgttggctgtcggcgggattgcatccaatcgccattgtgtcggcaccgagtttgacagtttgtgactagacaagccaggctgcgcggattgtcacgatcaagccacaagatgaatcctttacttgcctagatatttcgcattgttaatgcagagcgaagatgaacccgttgtctgcacgtcaacctaacaactgtatgtccatacatgacgggagatccgtattttcggtcaggtcctacctgtgttatgctgagaattctgcgaccgccaacaccaatttccacctgaggcggacacgctagaacgtaagtttccgaacaaccgggtgcttggccttgatcgcctgctgtgtattgatcgcgacgtccctcgtgtggtgaattgcgtaatgcagcgatggcgacgagcaccgcacccacaccaagcaccgacgccgacgcgttgatcgtcgctgtagacaatgtgcgtcgcatcaccaacttcgacggccccaggcccgacacatccgcaaacgtgcatcaactatctcaagaaaacatcaatgctcctggaccgtgccgagcgacggtcaacaacaatctagtattcgacaacggctgagaacaatttcgtagtatggcacatagctggaacaccgacaaccggttaccggggaaacgactctctttgaagaaagcagtcaggccgtgagtataccccccccccccgaaagggggctacggtacgttacgagcttgctcagctggtcgcatcattaacagagtgcgcttccttgcaagacgaaatcgacgatttcgtcttgaaccggtccaatgactccatgttatggctcagttcagcagattggaatcatgtatatcacgtgaaattatcggtttcgtatatccatcggtgtgttaattctggaaccaaccaagcaattcgcgaccggtcctcgacacgaggaccggtcgtatcagctagtaccgcgaacactgcgtcaagtattttttgaaaattcgtcaaggaccagtgctaattctggtatcgacgccaatagcagcgccaccaccaagtcgcctaagttcacctcgcaatagctaccggaagcacaattatatcgagactccgcagaaaacaccaccacaagcatttcagcggattcacaacacggtcgattgtaaattgctggtgtgcaggataccacgcaacgacccatcgagctgcggcgtatagaacgcccacgacttcacgagttgtcacaccttcggaataccttctcccatgtagcaatcccaccggaactcgaagtgcccaacccatctgatttcgtcccagctaaagcgagacagagtgggtaacctcgggttt

SEQ ID NO: 135 - DNA (genomic), 38675 bp, Mycobacterium leprae; double-stranded, circular
  hypothetical: NO
  anti-sense: NO
agttggtcgatccactcctgggtagggttgagcgcaatccgtgccccttcacggatcagttcacgcactcgtggcgacgggtgttgcctagccatgggctcactgtagggccgatgtatgcagattgacaccttgggtcgagccaaatgggaacatttcacccctgagccgtcgcagcgtaactgtcgtgtccggcgtaaattctttgtgccatcaatggcgtcgatgtcgacggtggatagcgggagcaagtggtccggaacaccagcaattgtgttgagtttaagccaagtaccactaggtgaacacgggctagacggatggctaattctgggttctgtctgcggagtgtgagtccgactgattgccggtctagtgtgcattctgcaccttcgtatgggcaaaattgggaagattgtaccaccgtccgggtcgatggggtgcactttgcaccttaaactgcggcaactcgggtggttttaacctgttataaactcttaacctgttgtaaacgttgcataacggagatcattaaggccagttcgtaccaccaagcagtcggaagggaggcgcaggtgagcaggtcgcttgagctttccccgtgcagtagtcggattgtttgagtttcgaggaggaaccgcatgccccttttcttgaatgcagagccacaggccctgaccgcggcagctaacaccttggagggcctcagtgctgccacagtggcaagcaacgccgcggcggcccagctgaccactgaaattgctcccccagctgccgatgatgtgtcaatcttgctagcacattttttcagtggccatgggagacagtaccaggcgcacgcctctcagggcgcgaccaatcatcaggatctaatccagagcttgttgacgagctcgtcagcatatgcgggtaccgagactgccaatcacgatagtttatagcggacgtcgctagctgcacacgagtggctaccaatgagtaataagggagcgacgagatgttcgatttcgcagcgctgtcgcccgagaccaactccacccggatgtatctcggcccgggctccagcccgatattgaccgctgccgcagcatgggttgttctggctaaggagctgactgctgcagcgcaggggttgcagtcagcggtcgaagcattactaacaacatttgaaggtgagtcagcagcggcgctggcagagcgggtcacgccgtatgagaagtggcttacccagaacgccgcaagcgccgagctgaccgcaacccagctcacggtagcagcgaacgcctacgaaacagcttttacaatgacggtgccgcccctgatggtgttcgtgaaccgcgcgcaagcatgcctgctgattatgagcaacattttcgggcaaaactccaccgcgatcgcggagaaggaggccgaatacaccgagatgtggatccaagacgcgacagcaatgaccagctatcaagctagtgtgctggaggcagtgggggcgacgaaagcgaatcggcgccgctgctggggggcgggctaccgatggcacctatggtccctggcggaggcagcggtactggcggcgtcaacactgcactacgcctgcaaccaagagctttcgtgatgccccgcaaccccgcagcgggataaaagctgcgaggttgacgtttcatccacaacgcaacgaaatcaatggaaggaaattataaaggatgacagctgcacattttatgaccgacccacaggcgatgcgggacatggcgcgcaaatttgacatgcacgcccagaacgtgcgagacgagtcccacaagatgttcatgtcctcgatggacatcgctggtgcgggctggagtgggaccgcccagttgacctcccacgacaccatggggcagataaatcaggcgtttcgccacatagtgaccctgctgcaggacgtgcgtgaccagctgggtaccgccgccgatcgctacgagcaccaagaagagaactcgaggaaaatcctttctggcagctagttgcgaaaatcgctgctaatcaatactttcagtgcaggaggagacaaagtaatgggaaacattaactaccagtttggggagatcgacgcacatggagcggctatccgcgctcaagcggctgcgttggagaccacccaccaggccattctagccactgtgcgggacgccgctgagttttggggcggacaaggttcgactgcccatgaaatgttcatagccgacctgggtcgtaacttccagatgatttacgagcaggccaactctcacggccaaaaggtgcaacgcgccagctcctccatggctgacactgaccgctctgtcagttccgcttggtcctaacgtaaaactacctaagagccgctcgctgtcaatgtcgacaccgggcggcttttccggcagtactgaagatcaggacttctcagctgcgagagcgctacctggcctgtagtccgatcaagttgtacttagggggatttgtgcggtaatgcctgtcggcttgtccggtaggaacaagtgcagaggagaacgagatggatttcggggcgttactacgcagagattaattcggcgaaaatgtatttcggcttgggttcgggctcgatgttggtggatgtctttcccgcggctgaggaggttgtcgaagatacggtgctggtactagtcggtgacgaggccgcagcgttggagcagttactgggccagacggctgatgtggccggcgcggccaaaagcgggcctgtccagccgatgggggatcgagggtctgtcagtccggtcggacagatggtccgcagtgcgctgcggactccgacgcgcgctttcgcgatgcccagttccccagccgccggatcgctccacttaggctaaattcatccccgacggttggccactcgctaccgttacttcggataagtgctggctgtgcatctcgtcggtgtcagcggtggggtccggcggttagttagtgtgcaaggcttcgttgagcgtgctccccctaccgtcgcgggctaccacctcgaccgcccctgttaccgaattgcgtcggaacaacaggttgctaccgccggagagcgcacgagccttaaccgatttgccttctggcgtattgaccttggtgccggtagtgacatataagccggcctcaacgatgcagtcgtcgcccaatgagatacccagacctgagttggctccgagcagacaccgcttgcctatggaaatgacctgtgtgccaccgccggacagggtacccatgatcgacgctccacccccgacgtgagagccttcgcccaccaccacccccgctgagatgcggccctccaccatcgatgcgcccagggtaccggcattgtagttgacaaagccctcgtgcatcacggtggtgccaggcgctaagtgggcgcctagccgcactcggtcggcgttggcgatgcgcactccggtggggacgacatagtcgaccatcctggggaatttgtcgacgccatagatggtgaccggtccgtggcgacgcagctgtgcccggacggtgtcgaaaccgtcgattgcgcagggtcccctactagtccaaaccacattggtcaatactccgaacaagccgtcggcgttcagcccgtgcggtgccaccagccggtgtgacagcatatgtaaccgtaggtaggcgtcgtaagcgtcggcggcgacttcgtccaatgagccgatgaccgtgcggaccgcgatggtctcagtgccacggtcgtcatcgcggccggtaagtacggccagctcgtagggaacgtcggacatcgccagttgcgaggtgacgctggtgcccgattcggtcagtttcggtgcgggaaaccaggtgtcgaggatcgatccgtcggcggccagcgtcgccagcccgatgccaaccccacctgcagttcctgtcacggcggtcaggttacttgctcggcctggaagacgtcatcagtaccctggtctgcgtgctggatttgcgcggggacccgattgagctgaccgcggcgctcgtcgacatccccagcgagtcacgggctgaagcacgcatcgctgatgcggtggagactgcgctgcgggcccagaccgccggcttcgagattgttcgtaacggcaacgctgtgttggcgcgcacctcgttgcaccggccggcgcgggtgctgctagccgggcacctagacaccgttccggtggccggaaacctgcctagccgctgcgagaaggacgtgctacacggctgcggcaccgtggatatgaaatccggtgatgcggttttcctacacttggcggccaccgtgaccgagccggtgcatgacttgacgttgatgttctacgactgtgaagaaatcgattctgcagcaaatggtttggttcgcatcgagcgggagctgccggagtggctcgccgctgacgtggccatcctgggtgagcccaccggcggctatatcgaggccggctgccaggggacgctgcgcgttgtgattaatgcggctggatcccgtgcgcattctgcacgttcctggttgggcgacaacgcaatccataaactgggtgctgtgctggaccggttggctgcatatcgggcgcgtaccgtcgacatcgatggatgtgtctaccgcgagggtctatctgctgtgcgcgtcgacggcggtgtggccggaaatgtgattcccgatgcggcctcagtgacagtcaattaccgctttgctcctgaccgttcggtggccgcggcgttgcgccatgtgcacgacgtgttcgatgggctcgacgtacagatcgagcagaccgacgcggcggtgggtgcgctgcctggcctgtcgcagccggccgccaaggccttggtcgaggccgctgacgggcaggtccgtgcgaaatacggttggacggatgtgtcacgattcgccgcgctgggtgtcccggcggttaactacggccctggtgaccccaacctggcgcaccggcacgacgaacgcgtgccggtcgtccagatcaccgctgctgtggatatgttgcgtcgatacctcggcggctgatctttggccgtccgtgatcggcatctggtagccgttcggctactgcgacagcagccactgagattatcccgatagctgccagcttcgcagacacagccgtcagggcagcaggatcacgtgtggccaatgcgcgttgtgccattggctcgacattgtagaaacggccttgccgctccgcgcacagtgtggccgcgctggcctcctaggccacccgccagatcacattggtcgacggtaagttttcagccacattgccggtgatttcggcggcttttcgacattgcccgcgttcatggcataagatagcgttaggcgcgtaggcctgcatccttgacctgattgcggatggttggcagaaatgcggtagtctatcccggctcccctagcatagggaattgtactggtgtcctacagcagtgttcaggccatcagatccggtggcgacagtgttgcggggtcggtgttgtttggcaacgcaccggcgttccggcctcggacttgccagggcgttggttagcgacagttgtgcatccaggcttgggggtctgggaagcgttgcagcgctcgagcgggttagtcgttagcccagtgtgaaggtcgctgagtcgcagcgtttgcttcgcggcggcgacttcatctaactgcttcggggcatcgctgtccaacaccagggacgccagccgcggctggtcactaagattgtccgacgaatgccgcaaatgcagcacgaccagatcggtgcggcgccatcgcgcaccgtcggcgtcaagcgcggcacgctcccgctcaccgaacagcggatgcgctgtgtaaatcatcgggttgtccgcgggttagttgcgtattcgggtttctgttgcgcctcattcttcggtctgccttactgtgccgtcgccggcgagggtggtgaggtcggcgagcgtcagcggctcctcgacggcgaggtaatccagtatcgtccgcctcggcataggtaacttggcgattaattcgtcgacctccgctggctcgggaggactttagtcacgtcgctgagtgcgtcccgcttcagcagaccttcggtccacagcgctgcactggtcctaggggcggcgtcagcgcgggtagtcacaatcatccggggccgtgacggtcagcgctaactgttacaccagtgtggtcgataggacgtctaggtcgtgggcatcgtcgatgacaagcagcagatcgcgcgccgtcgattcgtttttcgcctcaacgatgctcgggctgctcaccataacgcagctggtttcccgatatgggtgatgtcagccgggtggttgaaggcgccgaacgggaccgcactcggttggggtgccgataacctagcggatgacggtgctcgggtggcgaccgatgaattgttcagcggccaagcgggccaagatgggcttgccgacgccatcggctccaagtacaacggcacccacccggagacgatgtcgggtgggtgccagcttgacatggcggagcggggcgatttgatcccagactacgacaacctcacagaggggaaacatacagctgccccaaggcggccgcttgttgagggatgttccatcgaatcggtactgccggattttagttgtgtgcgggccggctggttgtgtggctggtgtaatggtcccaatggcgtcgggtctacctttgaacgactatgcgttcggatcgcggtaaacccaatgcgtgggcgatttgtgtcttttgcgcggctggaccgatgcacccggagctgctcgaactggccgccgaacttggtgaggcgattgctgagcgcggctggaccctggtctggggcggtggccgcgtttcagcgatgggtgcggtggcgtccgcggcgtggacacgcggcggtcggatagtcggcgtgatcccggaaatgttgcaacgccgcgagattgccgacacctatgtcggtgagctgatcgtcaccgaaacgatggccgaacgtaaacaggtcttggacgatcacgctgatgcgttcatcgtgttgccgggtggtctggggaccctcgatgagctattcgaagcatggaccgcgggctatttgggtatgcaccgtaaacccatcgtaatgctggacccctgggggcactacgaaggcctttgggcttggctgcacggattgatcgatagtggctatgtttcgccggtagcgatggagcggctggtggtggttgaccaggtggatgccgcgcttgaggcttgtatgtccgtctgagtttgcttgacaacggaaatttggagtgtaggtctgacccacggtgctgcgcgcacaattgagtcaacctgatcgatatcgtatctggggtcgctggcattttggccgatatgctgttgatcatatgaggagtgctgaccgggctttcggcttggccgagctcgaagaagtcgatcggcatcgtctatccagcagcgggcagctcgctccggtgactggattttcttcagattcgccgatcagctagtgagctaccgcgacggcaacgttaccgccaaccagtacgcagtagtggctggttgcatgcggtgtcggccctcacgacgtcgttgcgatgatgctgcgcaactcgtctaatacggtgctggctgtggttacgtgtgggtaccatgcggcgggcaatgcgcaactataaccagttgtgacgaggtattggcgcccagcctgggcttgctcgacgccaaggtgttgatcgcggagaccggtttggtcagcgctgtcgccgaatgcagtggctcgagtggcagcgagccgctgaccatctaggatccagagcgattcgtcgcgacagctcctgccacggcttctgcagtgttggcgaaagacatcgccttcgtacattttcccctgagggatcatcgaattacccaaactgagtgtgatgacttactactggcggctacgtgggctggtggcattcgacaagctgggcttatgcttgaagaactttaacacatggtacatccttttgcaaccataccacaaataacgctctgacggttacggcggcttccgtggtcgattcgaccttgacgttggccctggttgagctgtttttggcgttgcggttctaggaatagacgattgccagccggaccacggcgttcaatcgacatccagccggccaagctgaccgactggccagcaccgggtgcgcttgatcgccagcaaggggctactaccggagatttggaacgagttcaccacacgtttcggcattgcgcgggtgtgtgtgttgagtatcgttgcctctagcgaaggcaataccgcttcaatatcaatatcttcaatgtgtacggaactaccgggttctcgccggagccgctggctggtgtggagtatactattgacactggtgctccgctgcgcgacgctctccgggttggtcactgctcgttcaattcaggcgacgtgatgaggccgcacggtatgtgacatggctgcgtttgtcgaccggcttggtgacgcgttccgctggaagggtaataaagtcgccaccacacaggtcgaagtggtgctgacgtccgacaagtccgtcgaggagtgcatgatttttggtattgaggtttcatgcaccgccggctgcgccgggatggctgcgatcaagcggggcgaaggcgccgaattcgacggccgatttctggcccgcgcggtgtacggccagttgtatgcctactagctgccgctgttcgtgcggggtggtcgagtcgattatgcacaccaccacgtgcaagagttgcaaggtggagatgcgtaagcaagcttatgaccctaaatgtagcgggcccgctgaacgtgttggtctgccgtgccgacggctattttccctacacatactacgataggctaaccagccgaagtgtcgtctgtcaggtaagcgactgcaaggctgacgtccccgctcacgccgagtgtgcgactggtcgcacactcggcgtgaaggatggtcccgcaacaatgcggctggtcgtcaccaggcaatattgactggtgcagtcaatgctgtgcggccggccggtcgcagcggatcgccaactgatcatggcgatcgtcaaccgtaccccggattcgttctatgaccggggcgcgaccttcagtgacgaggctgctcgtgctgcagcgcaccgggccgttgcggagggcgccgatgtcatcgatgtcggcggcgttaaagcagggcctggtcagggcgttgacgtagacaccgagatcgcccggttggttccgttcatcgaatggctacgcagcgcctatacagacctgctgatcagcgtagacacctggcgagcagaggtagcaagactggcttgcactgcgggcgcagacctgatcaacgacagctggggtggagccgacccggccatgcatgaggtcgccgctgagcttggcgcgggcctggtgtgttcgcacaccggtggcgcgctgccccgcacgcgtccctttcgggtgagttacggtacgacgacccgcggtgtggtggacgatgtgattcgccaggtcactgcagctgccgagcgcgcggtcgcggccggggtaacccgcgattcggtgttggtcgacccgacccacgatttcggcaagaacactttccacgggctgctgctgttgcgtcatgtagacgaacttgttaagaccgggtggcccgtgctcatgtcgttgagcaataaggacttcgtcggggagactctgggcgtgggtttgacggaacggctagagggtacgttggcggccactgcgttggcggcggcagctggcgtccgcatgtttcgggtgcacgaggtcgtagcgaccaggcgggttctggagatggtggcttcgatccaggggacgcgtcccccaacgcgcacggtgaggggactcgcatgacggcatcggagttgatcgccagcgcgctagcggcccggtccggagatgcgtggctcgcggatcgcagctggagccgtccagcctggacgatcgacgaattggtggcagccaaggccgggcgggcaatctcggtggtgctaccggctctcaatgaggaacaaaccatcgaatcggtgatcgacagcatctcaccgctggtctccgatcgtgcggggctggtcgacgaactgatcgttctggactctggttcaacggacgagactgagatccgggccatcgctgccggcgcccgagtggtcagttgtgaacaggctatgcctgaggtcccaacccggcccggcaaaggtgaggcattgtggcgctcgcttgctgtgaccagcggcgacatcgtggtgttcgtcgattctgacctgatcaatccgcatcctatgtttgtgccgtggctggtcggtccgctgctcaccggcgacggcattcacctggtcaaaggtttttaccggcggccactaaacagcaacgatgcgggcggcagtgctcgtgccaccggtggcggccgggtcaccgagttggtggcccggccgttgttggcgtcgttgcggccgcagttgggatacgtgctgcagcccctgagcggcgagtacgcagctacccgcgaattgctgacagcgttgccctttgcaccgggctatggcgtggagatcggcctgctggtggacacctttgatcgactgggtcttgacgcgatcgcgcaggtaaacctgggcgttcgagcgcaccgtaaccggccgctggctgagttgggtgccatgagccgtcaggtgattgcgactttgctgtcgcgttgcggtattctcgactctggggttgggctgacccaattcttcgtcgacgagtccgacggtgacgggtacatccggcatacttggtcggtgtcgctggccgatcggcagtgagcagttgcggccgcgttaaggcaatatcgttcctgtggcgttggttttgttgtacctggtggtgttggtcctcgtcgcgatcgtactgtttggcgcagccagcctacttttcggtcgcggtgagcggctgccgcctttgcctcgcgggacgacggcgacggtgttgcctgcgcatggagtcaccggcgctgatgtcgacgctgtcaagttcacccaggtgttgcgcgggtacaagcccagtgaggtggattgggtgctggaccggctcggccgcgagctcgaggcgttacgtggtcagctcgcggctatcgccgacgccgaagcagatgccgatgtctcgaatgttcccagcggggacgacggccaggatgtgacgtgagcgacgatgggctggttcgctgtggctgggcggacgttcgatccgggctccactggcagctgtatcgcaactatcacgaccaagagtggggcagcccagtacgatgcggagtggccttgttcgagcggatgagcctggaggcctttcagagtggtctgtcgtggctgctcattctgcgcaaacgggaaaatttccggcgcgccttctccgggttcgatatcgaagaggtagcccgttatacccatgccgatgtgcaacggttgttgttcgatgacggaattgtgcgcaaccgcgtcaagatcgaggcgacaatcgccaacgcgcgtgcggccgctgagctggggtctgcagcagacttgtctgagttgctgtggtcattcgccccacagccgcggtccaggcccgctgacggatccgaaatcccttcgaccagtgcggaagcgaaggcgatggcgcgtgaattgaaacggcgcgggttccgcttcgtcgggcctactacggcctatgcacttatgcaggctacggggatggttgacgatcacatctgtacttgctgggtgcctccaacacggtgaccccaactttccgaacgggccaccgacgaggccttgttgtggggggcacacccagccgcgcagcagcgatggagcgagccgggcaactaggcacagcatcctggttaagcccgagaaccgggtctttgtgcattcaccgacctgaatagggaagaatagaggggtgatttggcagttcaatgttgggtattactgtaaatcccccgagggggcatgctcggcgccgaatgggtccgcgagggcgggccagctcgagtttggagggagcacacgatggcggcgatgaagcctcggaccggagacggtcctctggaagcgacgaaggaggggcgaggtatcgtgatgcgcgtaccattagagggtggcggacgactcgttgtcgagttgacaccggacgaagccgccgctctgagtgacgaacttaagggcgtcaccagctaaaccggccgtctggcaggtagttttggttgtgcacaactttccggtagatgtctagcgtttgttcggcgacgtgggcccaggagagttccttgatgcagcgccggggtccggcgtgaccattagccttcggcttttcctgggttggcgaccaaatcattgactgccgtggccaacctgccctggtaaccagtcgggtcgtcggggttgtaatgcaccagtgatccggtgatcccgtcggcgattacttcaggtacaccgccaacgtcgggggccactactgctgtagcgcacgccattgcctccaggttcacgattcctaacggctcgtgcaccgaaggacacacgaagactgttgctgtcgaaagtatttcgcgcatcttcccgatgggaagcatttctcggatgcaaaatacctcggtgcgattgcgggttagttaggagacggcggtccgcactttattgtttaactccagggtatcgggagtgccggcgtacagcaccagctatacgtccgggctaaaccggtgcgcggctgtcgccagatgagcgacaccctttctgtcgggtgatccatccgtcccacgaacgccacagtgggccagcttgagtctataccgagctcggacagtaccggacccgggtcggatgctatacatcgcgttccagatgacgtgcaccagtctcggatccagcgtgggatagatccgcagcataccggagctaaccgcgatgatcgcatgagcacccagcaccgcggtgtgctcgacccacgtcgacacccggtagccgctgttggattgttcggctttccctgggcgcagcggctcaagtgagtgtgcggtcagcgcatgggggatgtcgtagagcaacgcggcaagatgcccagccagaccggtgtaacaggtatattaatacacgatggtggccgctgacgcggtactggccgtcatcagatccgacgacaaggtaggtagacagtgccgcgttggcatcgtggaaccggcggtcaggctgatggtcctgggtgccggtgcgaggtgcgtccatgcaatgcgcatcgaccgcgcatagttggcgcagttgtgcgaccagttcggtgacgtgtacccccggtcccaccgtaggactctggcgggtactcccgagtcatcatggccacccgcataccggctcaccgtaatgcggtgactccgaatttgcgagtggtgcgtaagtcgagcccggggagaacctgaacagtgcgtcgaaccgagccaaataccttgacggacaggcacgtcaggacggcgccgtcgagggatgcccccctggcagcggtgggcagcggccgataggtttggagccatgagggaagtgccacaagtgctgggcattgttttggccggtggtgagggcaaacggttatatccgctgaccgcagaccgggccaaacccgctgttcccttcgggggcgcctatcggttggttgatttcgtactttctaatctagtcaacgcccgttacctgaggatttgtgttctcacacaatacaagtcgcattccctagaccgccacatttcgcagaattggcgattgtcgggccttgccggtgagtacattaccccggtgccagcacagcagcggttcggcccacactggtacactggctcggcggacgcgatctatcaatcactcaacctcatttatgacgaagaccctgactatctagtggttttcggagctgaccacgtgtaccggatggaccccgagcagatgctccggttccacatcggcagcggggccggtgccacggtggctggcattcgcgttccgcgcagcgacgctacagcgtttggttgcattgacgctgacgactccggccgtattcgccgtttcactgagaagccgctcaaaccgcccgggacaccggacgatcccgataagacgtttgtttcgatgggcaactacatcttcaccaccaaggtgctcgtcgacgcgattcgcgctgacgccgatgacgatcactcgtatcacgacatgggcggcgacatccttccgcggctggtggacggcgggatggccgcggtgtatgacttttcccaaaacgaagtgcctggcgctaccgactgggaccgcgcttattggcgcgacgttggtacgctggacgctttttatgacgcccacatggatctggtgtcgttgcgtccggtgtttaatctttacaacaagcgttggccgattcgtggcgaatcggaaaatctggcgccggcgaagtttgtcaacggtggttccgttcaggaatcggtggtgggtgcagggagtatcatttcggcggcttcggtacgtaattcggtgctgtcgtcgaatgtcgtggtcgacaacggcgcgatcgtggagggcagtgtcatcatgccgggtgctcgggttggccgcggcgcagtgatacgccacgcgatcttggataagaacgtcgtcgtcgggcctggcgagatggttggcgtggatcccgagagagatcgggaacactttgcgattagtgctggcggagtagtcgtggtcggcaagggtgtgtggatttagctcggtgctagctaggccagttgttgagctgtgtcgacatgtttgtcgaagcctatcgacacttgggtaagctatgatcgtggttggtaattttacgcagagcaattacgtgcctgcgtcgcgaggccgtcggtcgtcgcagctctccggcgacgaccgagaacaggcaatcctggccgttgctgaacggctcctggcggagcggccactgggtgacttttccgtcgatgaactagccaaaggcgccggaatctcgcgcccaaccttttatttctacttcccgtcaaagaacgcggtgttgttgtcgctgcttgatgatctgaatatgaagtcacgctcggcggttgaagcactcgctgaacagctgcccgcggaccccgccgcggtctggcggtccgcaatcacggcgttcttcgaggtgtgcgggactcaccgagcggtggctgttgctggtgccgcggccaaagccactagccctgaggtacgccggctgtggtccacagtcatgcagcagtggatcgactacaacacagctgcgattcaggctgagcgcaagtgcggcgtagcccccgacaccattcccgccgaggatctggctgtggcgctgcaattaatgaccgaacgcgtgatggccgcgacattctccgacgaaaagccgttgatccccgataagaaagttatcgacacgctcgtgcatatctggttggccagcatttacggcagttgaccgcgcaccatacgtaaggcgccagccgatagcgcacctgctgtgtgtattggcggtatccgctcaattcttgggtaaagctaccttctcctcgtcgcggatgcggaagacgggcaccgccacaccggggatgaccagcagccccagtaggacccgagcgccagcggtacgcccccttgccatgaatcacgttgccgacatacatcgggtgccggatgaacttgtatataccgccaacgctcatcgtctggccagcttccacggtgacggtggttgccgcatagccgttctggatgactaccaacaccgtgataccgagcctggctgctaccaacgcatcaccctgcaaggacacccaggtacctacctaccaatcggtctaatgcgctcaaaatcatcatcgcgaacaggtccataaccgacatcggtgatgacgatcttttacacggctttgccttccgcttgtgggccggtgtacatacgtcgccaacgtaacaaggttcaatcgggccaagtccaagtggagtcttgatgatgctttgcacctacctgtttttcgttctgctgagccaacctaattacatagatcgcatctttggaaagccttggttaccaatgttattagcacggcatcgatcgccaacagccaaagcaaaggtacgatggtgaagtcaccgccgccaacccaaggaacgtgtgtgaatgtgaatggttccagatcgaacacccactgcgagaatccagccaatgaaccgatcaagtaaaacgcgaagaatgcgatcagcactacccatggcacaggagtgaaccgccttgctaaattcagcaattggacttttactgcggtcaacaaccagatagcggtcagctgcacggtcgcggtgccggccattatggccaccatgccgtcgacgttacccgctgtggcactgtagacgagaacggacgctagtctctgcgaccaactttgctgccgaggatccaaccaaattatcgcttaaataatttgctagacaacgggttcagaaaaaaagaactggccacgctatctcggtacgctgactggattctttctggtgcagtcgcagggtaagcgaggtggtgaacgcgtcagcaaccatgcccatcattgtgaacgccaccgcgatgagcaagtggaacattcctgctttccggatgtctgccgctctaaggctgttgttgtagatctgcccgtagggggtgtgctgggtcgggctggccatgattgatggaatccgcgaattcggcatgggcggcctcagttaggtagatcatcgagatgcttcccacatacacgctggccagtggcggagacagcagcaacacccacaagcggcaacacgactcgatcacgccgcagatacagccggtagcctcccaagcgggccagagaagtttgagccgactagcgggcgccgcgtgcgccagatagtgcaatcgatccagggttgcggtgctcataacgtcgaccctctcttaccgctatgttcgcgctggtcggtgtcttcaattgtctgaaatgttgtagtggcgcaagaagggttttttaagaatcggtggctggcggatcaggctgcgtacaccggcgtaaccgaatatccggatctagttcctagaggatttgactgttgacctgggcgctcagcgtgttgccgtcgacgctctcgtcctagacaccctggatccagtttatattttccaggatcgcagataatttcggctttgatcgaggttcggctcaggtgccgcagagaggtcagagaaccgctcttgacgatcttactggctcggatgatggtcactcgtcggcacagtgcctctggttcggtcaggatgtggctggacaacagcatcgtcacgccgcggttgcacgcttcggcaacgcaaatgttcaaacatgttatccatcaacgagtcgaagccggtgcccggctcgtctaagagtagtagtggtagtcgggctcgtgaggaaaaggaaagaaatccgtgaagtctttttccagttgtttttcgagtaggtgcgtgctttcttatgtgggtcaaggtcgaagcgctttagtagctcgtcgcgctaactctcgtcgatgccgccacgcatgcggtccagcaaatcgatagtttcggtttcggttagcgaagaccacagcgtgacaattcctggcacataagcgatcttccggtgaaattctacggggtcggtccaagtgtcgccgccgagtagtagtagtagtgttttcgctgtcagtattagccaaaaccagtaggatgtggatggtggtacacttctcggtgctattaggtccgaggaagccgtgcatctgtcctgtgtgcaccgttaggtcaagttcatccaatgcacacaattaaacaggaactcttggtcagcttacgatttcgataggttctgagagctggtattcgattctcccgtcaatcggtcggcgtagatttccagtggagggcagtaggatttcgcgtgcatagtcgcgtagtaactcacgcagttccgttgaattttcgtgtatatgcagatacagcaggtagctactgctacccgttatcgccagatactttgccctggtttggggatcgcgacttggcttacgcgtttcagatgcgtacttcctcgtcaaggtacactttgtcgtcatccattattttgtgcagcaatatagttgctcattcatcgccagattgcatacttgtgcacccagtaggttatcagcggtgtgtaagacttgacctcggctacttgcgcaagccatgtcgccgggttgcggactacatcgctggccgacttgccgctgcagacctctttaacgaggtaggcatcgcacgctttgtgacggccgtccttgaagccgaaagtggtggatgaccagcgacgcgcctatccccctgcttcggcgatggcgcgcaaactggcttcgaagttgtgttcgccgaacaactcgatgactgcatcgcggatccgagcggcagcggtcagatcgactgaacattgtgtgttggatgctaaacgtgcgttcagttctcggtcaatgatgtggtgcgttaggaatccgtaaaattggttattcgcggactgcggccagcagcccatcgccgagtggcaccagcgcaggggtgagtcgctcgttttcggcgatgagtcgggctgcctcgcgaaccgcggtcacctcggcatcgcgtgccgcgggatcaccggcccgcccgcctaacgccgctcggtgcaccacgatgatcccgcaagatcgcagcagtcgcacgccctcgacgacgtaagccggctggtcgatcgggtcggcgtcgatgaacaccaggtcataggattcgtccgcgagccgggtcagtacatcttggccgcggccgctgattagccgggtacgcgacggcccaatacccgcctcggagaatgcctgcttggccagccgcagatactcgggctcgatatcgattgtggtcaagacaccgtcgtagctcatgccagacaacaaccatagtccgctgactccggcaccggtaccgacctcagcgacggctttgccgccgctgagcttggtcagcaggctcaatagtgccccgaccgcgggtgttaccgccctggcgccgatctcttcggagcgctcgcgtgcgctggccaggatgcgtcttctgatatcgacccctctgcgtgtgcgaagagtgaatcggctcgactggcggccgcttggtcgggggtgaccgcattgttaccggtaccgtacatgcccgcagcgtatgtcgaattcgcagcgtggtcaggcaggcgcgcttagtgtggcgacggcgagcggttggtaccagcggtgcgagtaaggggccacgtaattagcctcggcgcagcgacctgcggtcgtggcctggtgaccatcgcgacacgctccataaatctcgaagcgacgaacatcacattcgcggtgtgcaccgcgaattctgctgtgcagcgctgttcaagctatggtttctcaggtaaaccgcagtttgctcctatatcgcgtatacgccgatgggtgacggtatcggtatggaacgtgaagggcgctggaccgggaatacacagtgcccattgcgtgttgtgccgggtgacgaatcgcctaccctcgacggaagagcaagtccggaggatctgattatcaccaacttgttgagcccgaccataatgtctcatcccccacccagccgagacgacgactgggtagaaccatttgacgcgttgcagggcaccgcggtattcgacgcgactggggacaaggcaacgatgcctgctgtgggaggaattggtgcgtcaacacgcggctcgggtatattggctagcttatcgcctttcaggcaaccagcacgacgctgaggacttgacgcaagagaccttcattcgagtgttccgatcggtccagaactaccagccaggaacctttgagggatggctgcatcgcatcacgacgaatctgttccttgatatggtccgtcggcgtgcccgtatccgcatggacgccttgcccgatgattacgaccgggtacctgccgacgagcccaatcccgagcagatctatcacgattcgaggctgggacctgatctacaggctgccttagattcactgccgccggaatttcgtgccgctgtcgtgctgtgtgacatcgaaggtttgtcctacgaggagatcggtgcaaccttgggtgtgaagctgggcaccgtacgtagccgcatacaccgcggccggcaggcgctacgcgactacctcctaaccgcgcatcccagagacggtgccaccaccgacgctacgcacgttaagtcggcgtagtatcccccattctccaaagacatcgttctgtggtgtccaggaggaactggccgggccaaaataatactgaggtttgccggcgttatacgagtattgggcactacgccgcgctacattctaggtatgggcggcagtgaaaggggctggtgatggccgaccgcgggcaggtgttccggcgcgtgttctcttggctccctgctcaatttgcgtcccagaacgatgcgccagtaggcgcgccacggcggttcggctccaccgaacatctgtccgtcgaggcgatcgcggcgtttgtcgatggtgagttgcgaatgaacgcgcacttgcgcgctgcgcatcacatttcgctctgcgctcaatgcgcggccgaagtcgatgatcaaagccgaacgcgtgcagcgctgcgtgactctcacccgattcgcatcccgagcacgttattcggattactgactgcaattccgcgctgttcgcctgactacacatcgccggtctctgagcccttttcggaaggatcagtatccgaccgtttcgttgatggcgttgcccgtgaacagggtaaacgctgatagcttgacagctaagttaccgagttcaggtgatagctgctggcgtgtgactgcgtgccgaccaagcggggacggtgaatactagggtggacaccgacaacgcggtaatccgatatcggcgccgtaacaggccctgtctcgagcgctcagaagaggataatgtgacctccgaccaaggcaccaacaacgaccaaaatcccggccatcacctggcgacgcgccccgtcgccaggcctcctgtcgacgccgcgtcccgtgaggcgttcggccgcccctgtgggttttcgggatcctttgtagctgaatatgtgcgcccacagaaatatcgagaccgcagcgaattcaggcctgatgatcaaccagccgaccccgtccttgccgaggcattcagccggccattcgggagcgtcgattcgctgcagcgccatcctatcgatgcgggtgcgctggctgctgagaaagatgccactcagctggacgaacccgatgatccgtggcgagaccctgcggctgcggctactctggcgagtcctgcagtggcttcaccggtgccgcacactgagttgggtcaatgcggcaaactcggtgtgcgcgacgtgctatttggcggcagagtgtcctaccttgccctggtcatcttggtctttattgctttggcgctgggtgctatcggcggtgtgatcggtcgtaagacggctgaaatcgtcgacgcgttcaccacgtcgaaagtgacgttggcaaccactaacaatactgaagagccggccggtcgtttcgccaaggtggcggcggcggtagctgactccgtggtgacgattgagtcgaagagtgaccaggaggaaatgcagggctccggtgtcatcatcgatggccgcggctacatcgtcactaacaaccacgtgatttccgaagcggccaacaagcccagccagttcaagacgaccgtggtgttcaacgacggcaaggacgtgcccgccaatctggtgggccgcgaccccaagaccgacctggccgtactcaaggtcgataacgtcgacaacctgacggtggcgcggcttggtgattccggcaaggtgcgggttggtgatgaggttatcgcagcgggtgcgccgcttgggctgcgcagcacggtgacccacggcatcgttagcgcactgcaccgccctgtcccgttatcgggagagggatctgacacggacaccgtcatcgatgccatccagaccgacgcatcaatcaaccatggcaactctggtgggccgctgatcgacatggattcccaggtgatcggcatcaatactgccggcaagtcactgtcggacagcgccagtgggctgagctttgcgatcccggtcgacgagatgaaatcggttgtgcaaacactgatcaaggacggcaagatcgtgcacccgacgttgggggtcagcacccggtcggtgagcaacgctatcgcgtccggcgcccaggtggccaatgtgaaggcaggaagccccgcgcaaaagggcggaatcctggaaaacgacgtcatagtcaaggtcggcaaccggaaagtcgccgacgccgatgagttcatcgttgccgtgcggcagctgaccattggacaggacgcctcagtagaggtggtccgcgacggtcggcacgtcacgctgacggtgaaatccgaccccgatagtagctagtgttcgccaacattggttggggggaaatgctcgtccttgtggtcgtcgggctggtggcgcttggcccggaacggtttcccggagccatccgctggacgttgggcgcactgcggcagacgcgcgattacctcagcggtgtgaccaaccagctgcgcgaggacattggccccgagttcgacgatctgcgtggccaattcggggagctacagaagttgcggggtatgacaccccgtgcagcgcttaccaagcacctcctcgacggcgatgactccctgtttacggggaacttcgaccggcctgctgcggctaaacaacaggaccgcgaccatcaccagacgccattcgatactgatgcgacctgattttagcttcacttgctgcaagattgttgaattgtactttgtgtgcatgttctgttgtgggggtggagtaaagggtggcggtgtgttgcagtgttgtgagttgatgtgatcgatcgttaaccgttcgtttgggttgggtgggggtggggatcgtgcgtgagatcaccagcaagggtggggcccgcgtgtttgcgggttgctttgggggttgcactgattcgacaccaactatgctggctaagacgctcaatcgggttactgagcttgtattgcttagctatgcagtgagcagtgggcccagtggctttaaaggccggcaaggtgagcgttgtgggcagctgcgtacggagatagacatgtgtgctggccaagaagtacagtcccgaacaaattgtgggggtgttggcccaaaacctatcccgaccggcccgaaagatgcaggtgtcctataaaacacttcaacatcgagtccaagctcaaccaacatgtgcgcactgggtggatgttccgcacgctgagggcacagcacgctaaaaccgggcaccaccattattctctaggtatggccaccaccagtgcacgtcccgcgaaaactacacgaccgtgtggtgctctaacctcatagcattgggcggatgatgtaatcatcggcaaaaattagacccccaaatcggcgccctggccgaacacaagtagcggattcgtgcagctgctacacctatccaaggaccacagcactgatgtgatcactgcggccatgatcaaccacaagacaacgccctaccacagaatcgctgtacaaccccagcgtgagaccaagacctcgaaacgactctcatacccgcatcaccacggcatcgataccgacctttgcgacctgacgcaccgacccgccaatacactgacccaccaccctttactccacccccacaacagaacatgcacacaaagtacaagtcaacagttacatttcgacgaatgtgaaccgccgacgaacttgccagtgcgactccttagcgttagcgccgcgacgggtcgagccccagtgacacccctgccagtctgcgctgccgcgatgacaatccgtcggcgatgcggagcagttccttgcctaccggcgagtcggacgcgttcaacacgattggtatacccgaatcaccggcggccaccagcgcggggtccagcgggatctgacccagcagcggcacgtcggtgccgactgcacgtgagagccgctcggcgacttgttggcctccgccttcgccaaatacttgtagtcttgagccgtccggcatcataagtcccgacatgttctccacgacaccgacaatacgttggcgggtctgtagggcgatgctgccggctcgttcggctacctcggctgcggccagctgtggcgtggtcaccacgagaatctcggcgttcgggattaactgagctaccgagatggcgatgtcgccggtgcccggcggcagatcgagcatcagcacgtccagatcgccccaatacacgtcggatagaaactgctgcaatgcccggtgcagcattggcccgcgccatattaccggcgtgttgccctcggtgaactggcctatcgagatgacttttacctcgtggacgataggcggtaaaatcattgactcaagctgtataggtcgctggttgctacccatcatccgggggatggagtggccgtggatgtcggcgtcgagaaccccgaccgccaggccgcgggcagcaatcgccgtggctaggttgacggtgacggtggactttccgactcctcccttgccggatgccactgtatacactcgggtcagcgagttgggttgagcgaacgggatcatcggttcacgggcatcaccgcgtaactttttgcgcaacttggtgcgctgctcgtcgctcatcacgtccagactgacctccactgccgcggtgccgggaacgtcagcaatagccttggtgacgcgtttactgatttcggattttttcgggcagctagcgatggtcaggtaaatccctacctgtacgttgccacccggctcgatgtcgatgtttttgaccatcccgagttcagtgatggggcgctgtagttcggggtcgatcacttttgccagcgctgtgctgaccgccgatttcaggtcggcagcgttacgatcagttctagacatcacagccgagtgtaggtggctcgacgttcgctcggcccgccgagtagtcagttggccggagcgggcgccgagctcgatgggtcgatgcagatcagtgtggcagcaaggcagtggcgctactggttgcgatgtgccgggtgccagccacgaacacacattggcggctgcctaacgggcttgaagtcgatcagtggcagctgggctatcggatcctcgttaatcggctgtgtcgttgacgttcaacggcagtctagggccgagtccatccggacgttcgaggtgtgcgtcgccaagtagcgacaccggctcggtgattggcagcagatccaccaggtgacgccggtggcataggtcgcgacccaacccagcacgttctgtgcgtatgtcgccgagttgagtgcttgtagcataagaccccgacgaataacctgcggtagatggcgcaggttggtcccgtcgctgcataggtaccgggcagtggccagtgtggaagtctgaacagattttgtggatcggctgtgcccggccgatgccgtggcctttgacgtcgaaggcgtatcgtgctccggacgtaggcacccgcgttgttcgacgcgcctgctactgcactgctgcgacggccggatttgcaccccagcgttcccttatgcgcacgcaaactatcctcagtgcgctgtgggcaaccacatcttctaacctattacttagtctcatgaacaaatttaccgtacataacacaattcttgtgaccggagtagcgcaatgagggcgtggttctcacctggatttcttcgtgcgccgatcgatgccgtcaccggtctggatcggctcgatacacgagtcttttagtgcttgatgtgggtattcgcgcgtcctgaccttgccgatagctggccacaaagtagccagttagcgggtaaaatactcggtgtcgaacttggtgtgcgcagcgttacgacgatcttcttcgagtgcaactcggtctcggttctcttaacgattctgggctagccgaatgagcggtgccgcgtaggcggcttgtgtggagaaaagccaggttgagcacgattaatagggtatggatcccagcgccacttgagtgcgaacagattcaatgcgacccacaacaacaccacgattgtgtgcagcagcagatagcagccggtgctaaagaaacgcgcgattgactcggtgatgtgctcggacggtctcggcggcccaactcggtggcaacctgcgcgatgttcgtgtggtaagcatcgtagcggggggacttccgcataaggatccctcctggtgcaccggtggattccgtcctctgagagctctggcacatccacgcgccaatcgtaaggcagaagatggtcgaacaggtcggtccacgctcacctctaccgaaaggtgattttggttgtctagcaccggcccgtgtaacagggcgcaggcggccaggtaccgggtcaccgggaccaaggaagtctccggtgtcagcgtaggtgtaggtagttgagtgttgataattccacggactagcttggctgccgctttgcggagcagccgttaaaggtgtacgtagcctaggtagacacccggtaaggtgtggctgtgggcgggttgggctacgaacaccattgacgacagcgtgggggaaggtcggaatcatcgctgccacccgcagaatcaggatgaaaatgctgcggctggtcgcccaattggcggccaatcccaggattcgtggttgctggtgtacgatacttatgctgatcacgacatcacggattcgcctgcaggattcgtcaagtgggcccaataccaacatccgcgagagcagcgccatatgcaccttattgaccgatcccatgccggtagagcgcaagcagccgcgtcccagataggcagttgcccggatcggtatggtagtaccacacaggcttagtgcgaatgcagcgcgaatactgcgacggtcaaactcaccagcagggtcgcgatcccgatcactatgccggcaacggctaggccgtagccttcttggcgagtccgcttggtctgctcgagggcgatggcgccgagcacgatggccaggatcgagcctatgcagcacaccaacccggcgaacgaggatattagcgaggcgatcgccatcacgttcattcctggctgtgttgctccgtaaccccccaggtaattcggcggatagtagccccccggatagttgcctggatattcacccggatgccaaagtgacccaggaccatggccagttgcaggtgtgccaaattgcggcggtgggtagggcggcccaccatagcttagcggttgtccgtatcccggtggggtgggcgctatgggttctggatagtcggtcggaaggtccgacggatagcctggaggaacatcaggtagcggatatgtcgcgtgcgtgtgatcggctgcgtgcggtggtgcggtcggatgccaggggccaccccaaaccggctgtcttgggggcctcgtaacggctggcgggttcgcctcatcttcgtgggcactctcgccgaaggcgtcgccgggagctgtcatgctgttaaacattagcctatgcgctatcggtggctgcggtcgcaaatcgaaggcggtagcggatgattcgacgggttggtgagacggcgtggtgtcgggtcagcactggatccacaactacgggtgtgctctgcgtgccgtggggcctggcactgaaagcgagggatgtcatgtttgattaaagtaaaggttgtcttgtctgcaggtttctctggagagtgtggaagtgttcagatgaaacgatggtccaggaatgagagggcagaggagaatgtgagcatcgatgactagccttttccgtctggacaggttcctgcgacgacgggcgcgggtcgccttgacaggcccgggttaccgacttcgcccaaaggctggcctgtcgggccgtagctgaagctatgccgaagaaaagcaggtcattcactagcaactatccgaaaagtaattctcggttcagcaggtgaccattgttggtgtcgaccgcatgtgcagatggaatgggttacatgtcagttaacatgggcaaaagtacttgggtgacggcgtactgagcgggccctggcttggtttgtttatcgggttggtttttggcttctatttttttagtcctaatccgtgtgtgacgttgaccactagtttggtcgccagtgtgttttcggttgatgacttccgcagttccctacgcaatgacccgtggtacaaggaatttcagtttcactttacaccaacttcagtttgactttacaatttttagtggccgaccgctacaacgtactctgctatccggacaatgcggagaaggcgcgcgatctgctgacgcgcctggcgatctggcaccttgacgggaggggaggaggtggtggtgagtcggcgcgtccaccgagcgggtacaatcatacttgcagctttgacccttgcgtcagtggtgttggcctgtggggccggcggtgaccagttagtgattagcttctacacacctgctagcgaggatgcgacatttaccgaggttgcccggcgctgcactgagcaattcgacggtcggttcgccattcagcatgtgagtctgccgaggtcgccagacgagcagcgactgcaattggcccggcgactgaccggtaaagaccgcagcttggacgtgatggcgatggatgtggtgtggacagcggagttcgctgaggcgggatggacgctgccgctatctgaagacccggcggggctggctgagcccgacgcgatcgttgacactctcccgggcccactcgcgacagccacttggaagcgcaaattgtatgccgcgcctgtcactactaatacccaattgctctggtaccgaacagatttggtggatcaaccgccaggtgattggaatggcatggtggctgaggcggctcggttgcatgcggccggcgagcccagctggattgccgtgcaggccaaccagggtgagggactcgtggtgtggttcaacacgctgttagcgagtgcgggcggtcaggtgctgtccgaggatggtcgtcacgtcaccttgactgacacgccggagcaccgggctgccaccgtccgcgcgttgcggatcatcaaggcggtggctaccgtacccggagccgacccgtcgattacccggaccgatgaagctaccgcgcggttagcggtcgagcaaggaaaggctgcgctggaggtcaactggccgttcgtgctggcgtcgatgctagagaacgcggtgaagggcggggtggctttcctgccgctagatcggatctccgagttggccggtagcatcaacaacgtcgggacattcgtgcccaacgacgaacaatttcgcattgcgtatcaggctacccggaatgtgtttggtttcgcgccgtatcccagtgtgtcgcgtagcgaaccggccaaggtgacgatcggcgggctgaacctggcggtggctagcaccagccgtcataaggccgaagcgtttgaagccgtaaggtgtctgcgcagtgagcaaagccagcagtacctctcgatcgaagggggtctcccggcagtacgggcctcgctgtactccgacccagcctttcaggacaagtacccgatgtataccatcattcgacaacagctgaccgatgccgcggtgcggccggtgacgccggcttatcaggcggtttcgatccggctgtcggccgcgctgaatcccatcaccgacattgacccggagcccatggccgaccggctcgctgcgcaggtgcaaaaggctatcgacgggaagggcttgttgccgtgaccgtctgcttgtggggagagcagcggctatgacagcggtggtcggcaagtcgtggcacgtgcgcgccagcagtgtgcagccagaacagcgactggcgtttcttctggttacgcccgcggcgatgttgatgctggtggtgacggcctatcctatcggatacgcggtctggctgagtctgcaacgttacagcttggcgaccccgaacgagactgtgtttatcggtttaggcaactaccaaacaatcttgaccgacccgtattggtggacggcacttgcggtgactttggcgatcactgtggtttcagtgtcgatcgaattcattctgggcctgatgctggcgctggtgatgcaccgcaccctcctcggcaagagcctggtgcgcatcgcggtgctcatcccttacagcatcgtcacggtggtcgcgtcatacagttggtattatgcctggacgccgggcaccggatatttggcgagcctgctgccccaaggtagtgtgccgttgaccgaacagatcccgtctttgagcatagttatcatcgtggaggtctggaagactaccccgttcatgtcgttgttgttactggtcgggttggcactggttcctgaggatttgcttaaagctgcgcagatggatggcgctggtgcgtggcggcggctgaccaagatcatcttgccgatcattaagccggcggtcatggtggcgttgttattccggacgttggacgcgttccgcattttcgacaacatctatgtgttgacccgaggcgtcaacaacaccgattcggtatcgatcctgggctacgacaacctgtttaaaggattcaacgtggggcttggctcggctatcagtgtgctgatcttcggctgcgtagctctaatcgcggtgattttcatcaaggtgttcggtgtcgtggcgcccggaggtgacagcaatgggtattgaaaaagtaaaagtaacggcaggggttcgggtgggtgcgcggcgcgccacgatttgggtaatcatcgacaccttcgtggtgggatatgcgttattgccagtgctgtggattctcagcctgtcactcaaaccagcgtcaacggtcaaggacggcaagctgattccgtcgttagtgactttcgacaactatcgcggcatctttcgaagcgatcttttcagctcggcgctgatcaactccatcgggatcggattgactaccaccgtgatagcggtgatgttcggtgcgatggcagcctacgcgattgcccggctggctttccccggcaagcggttacttgttggtaccaccctgctggtcactatgttcccagcgatttcgttggtgacgccgttgttcaacatcgaacgccgggtcggtctgttcgatacgtgggctgggctgattttgccctacatcactttcgcgttgccgcttgctatctataccttgtcagcattcttcgccgaaattccttgggatttagagaaagccgccaagatggatggcgccacgtcgggtcaggctttccgtaaggtgattgtcccgctggcggcaccgggcttggtcaccgcggcgattctggtgttcatcttcgcttggaatgatctgctgctagcattgtcgttgacctccactaaggcggcgataacagccccggttgcaatcacaaactttactggcagttcacagttcgaggagccgaccggctcgattgcggctggggcaattgtgattacagcgccgatcatcgtctttgtttggattttccagcgacgaattgttgccgggttaacttctggtgctgtgaagggatagctcgatggccgagattgtgctggagcacgtcaacaagaattacccgaacggtgcgacggcggtgcatgacctttccatcaccgtcgccgacggggaattcctcatcctgatagggccttcaggctgcggcaagaccacgactctgaatatgattgctggacttgaggatatttcttcgggtgagctaagaatcgacggcgatcgggtcaacgagaaggcgcccaaggatcgtgatatcgcgatggtgttccagtcttacgcgctttacccgcatatgaccgtgcgacagaatatcgcgttcccgctgatgctggccaaggtgaagaaagcggagatagcgcagaaggtttccgagactgctcaaatccttgatttgaccgatcttttggaccgtaagccctcgcagttgtctggcgggcaacgacaacgggtcgcgatgggccgggcaattgttcgtcaccccaaggcattcttgatggacgagccgttgtccaacctggatgctaaactacgggtgcggacgcgtggtgaaatcgcccggctgcagcgcaggttgggtgccaccaccgtttatgtcacccacgatcaaactgaagccatgacgctaggggatcgcgtggtggtcatgcgctctggtgttgtacagcagatcggtacgcccgatgagctttatgaacgtccggtcaatctcttcgtcgcggggtttatcggttcgccggtgatgaatttcttccctgccaagttgacaccgaacggactgaccctgcccttgggggaactgaacttgtcgcgggacgtccaggcgatgatcggacagcacccggtgccggacagggttattgtcggggtgcgacccgagcatctgaccgatgctaagttgatcgacgcacatcaacacggcacggtgttaacttttaaggtgaaggttgacttggtcgaatcactgggggccgacaaatacatctattttactacgactggttgtgatgtgtattcagcccagttggacgagttagcttccgagttggaagtacgtgaaaatcagtttgtggcaagagtttccgctgaatcaaaaatggccataggagagtcgattgagttggctttcggcacagcaaaaatagctgttttcgacgctgactctggggtgaatctgactgtttctgcaccgactgatgcgtagtgacacaggactctggcacaagtacgtgcatacctgtgcagcatgttcactgaggtaggtaccctagatatactcattgagtccgattccgtgagcgtgacgttcctgggtaccgaatctatcgagatgttgcgattacgttctggagcagacggattgctatactaagtgtgattggggtgctcgcgttattcgatgaatgatccgaccgagattccagctgaccaattgcgtagcccacgtgttgaagttgttctgtccctgcgtgatctcgggccgatcaccggactggtacgcacctggcggtcgacggtgtggtgctggtcgaggacgctctgatcaacctcagatcgctgctgtgggcaaaaccatcggggcgtttgctgtttaatcgtggtgttgttaggtcgcagtagtattcctgagctgccgatgcagcctcttcggggtctagtactttttctatcggtgactcctgtcacagcgactgaggaatcctggttgtggctcaaggaaactcttggtgctcaagctatgcggcaggatggcagacgacgtgctggatccgaatcgccgtattgcacaatttcactgacggcgggcagctgcggcacgcattgttgccaggctacagccagttcctgtttcggaattgccagtaaagaaccaggcagacaatggtcattccggccattaccagcgggtaactccacgtccagttcagctcgggcatgaaacggaagttcataccgtagatggcggcgaccatagtgggcatcgccacgatgccggcccaggccgccatcttgcgcatatcgttgttctgctgcatcccgacacgagccaatgcggcctgtactagtgaattgagcatgtcgtcatagctggctatttgatctgcggcctcggtctggtggtcagctacgtcacgcaggtagcggcgcaattctttggagattaagtctttgttatccgtttgcattcgctggagtgcggcggagagcggggcaacacagcggcgaagttcgatgacctcgcgcttgagtaggtaaatcggctcgacgttgagcttgcggccgggagcaaacgccacttcctcgatggcgtcgatatcgccttccatcagattggtcaccgctaaatagcggtctaccacgtagtccgagatggcatgcatcacagcgtacgagcccagccgcagatgctcggggtcggtatccattcgcttacgcacctcggacagctcaccatgctcgccgtggcggaccgtgaccacgaaattcttgccgacgaagatcatcacctcgccggtttcgacgatctggcgggccagcaccaccgattcgtgcggtacataattgacggtcttgaggaccagaaacaacgtgtcgtcgtagcgttccaacttgggccgctgatgggcgtgcacggcgtcctcgactgccaaggggtgtagcccgaaaacgtcggcgacgttatgcatgtggcttgcttcaggctcgtgtaacccgatccagacgaatccctcgttccccatcagttcgatctcgcgcaccctgctcagcgcggcggtgtacgttgtgtatttgtcgggtagccgatggcctccgacatagacgccgcagtcgaccaagggctcggtgagcggggggaaaatgggatgtacgtgaggcgtgtacagtcggggcttcgtgaccggcctcagcgcttcaggtaacgggtcaaaccccgggaacatctcaacccccatcgcggcacaggtgttattaggtggtgttttatggtacgcgttttggccagaacagtggaggactgattgagtgttggaatgggtcccagagggaagtagaactgctggaccgaaaatctcgggtcggtaaggatgcgctagtttccatccaagcttgaaactcgtaccgatagctcgagccgaacctctctccgataaggagtaatcgaagtgagcccacgtcccctcaaggtcgccgtaaccggcgctgccggtcagatcggttatagcctgctgttccgcttggcgagcggctcactgctggggcttgaccgcccgattgagttgcgtctgcttgagattgagcccgcgctcaaggcgctcgagggtgtcgtgatggaacttgatgactgcgcgttcctgctgttggcgggcgtcgagataggcgcggatccgaacaaggtcttcgacggtgtcaacctggccctgcttgtcggtgcccggccgcgcgggccgggcatggaacgtggcgatttattggaggctaacggcgcgatattcactgcgcagggcaaggccctcaacgccgtcgccgccgctgacatccgtgtcggtgtgactggcaatccggccaacaccaacgcgctgatcgcgatgaccaacgcgcccgacatcccccgcgagcggttctcggcacttacccgtctggaccacaaccgggctattgcgcagctagccacgaagaccggctccgcagtcaccgacatcaggaagatgacgatctggggcaaccactcggccacccaataccccgacgttttccacgctgagatcggcggtaagaacgcggccgaggtcgtgggggaccaagcttggatcgaggactactttatcccgaccgtcgccaagcgcggtgctgcgatcatcgatgcacgcggcgcttcgtcagccgcttcggcagcatcggcgaccattgatgccgcccgggactggctgctgggcacccctgagggcaactgggtttcgatggcggtggtatccgatggttcgtacggtgtgccggagggcctgatctcttcgttccctgtaaccaccacggatggagactggacgatcgtcaggggcttggggatcgatgacttctcccgcgggcggatcgacaagtcgaccgcagagctggccgacgagcgtatggcggtcaagcagctcggtctgatttaggggcggttccgcgctagacgtctgtcacccgtcgtggccgagactaccggaggttctcggcgttccccggttccgtctctcaggccgtcgttgccgataaacaaggagccgagtccgctaaggcagcccgcgccgccgttacctgcaaagccgaagccgccaggttccccggtgtcacccggggtgagacagtcgttactgtcggtgccgccattgcccccgctaccgcgggattgcatgcaccgacggtgctgatggccggcctggctggtggaatcgggttttagattgacaccgccggcgtcaggccaggcagcgcctgccccgctggtgtttaccatttccgctaatgccaagcagttcctgtgttgccatcgacgccgccgttgccataaatcatcgctgccatcgacgccgtctccgccgttttaccccggacggccattggcaccgttggcgatcagcaggaatcccagcagctgggtgggtgcattgaccaaggtccagcgtctgctgtagcagcatacgacactccggcggagctcaacctccgcataaactgctgctgaaacgctgccgcctgtgtgctaaatacttgatgggcctgggcgttcgaagaaaacagcgacgtgatcgccgccaacacctcatcagcgtccgcggccaacagcttcgtgggcggggtcaccggctgccccattgttcacgaccagtgttgtgccgatagtctccaaacccgttgctaccgccgtcaacaagtcttgtgccgcaatcagatacaccatggcgaacctctcagccggctaaatcgaacaatagggcaggtccaaagggtatcgtctgtgctcgacaggacattcggcgtttcgtctgcctagacttgcagtactctcgaccctgtgctaaaaatcgaccagccgctacagattgtcatcgacgacgatatctttcgggctcacgtaggtgagaagttttccgttgcgctgaagactccgttggatgctcaacgcgcgttctcggtcccctacactccaggcgtggcgcaggtaagtcatgcgatcgccgcgaatcgcgccctggctgtctgttatacgtgggtgaaccggttccgtcgtaagcgatggaagcgctgtaatcgggttcgagtgatatcggacccgcggcgttgttgctgatgatggagggcaagtgcgtgctgttcaagatatgtcgcgggcgtaacgcgatctcgatcgtgctggataccagggatctcggcgaggtcgtaaaaacccctggtgaggctgtgctcgacgttcgacaccgtcaacctcgaggacattcttcgcactgcgctgcttcgagatcgaacggtgggttgtcgggatgctggattgcccggttatgtatgacgaccagaatggtacggcgatcgtcgtgcttgttgcaccgatggttgctatcatattactcggccgcggcatgtcttcgctgaatgtggtaggtgtccggcgccggtaccgcaggggctacttccacgaatctttttcttaccatcggtgtttcagacactactgtgcgcgattcgcttggcattctgcataccgggtgcgacgacatgaactgcgtgaagttagtttgatttggcgcgatgtaccaactccggcggtctcaccggcgacatggccgaggtgctcgctggcgttgctgtgttctttggggtgtaggcggtcttggtccctcgaagaattgcttgtcatgatggcacctgacgggatcgtgttcgtgctgtccgatccggacccggaaatacatcccggcgttgctgccaaatacgtggcagtggtggctatcgggcgtagtgacttctgcagccagatcaacagcgtgcttgtgtttcctggtgtcttttgcggagcgctggacgccgaaacgagtcggatcaccgaaaagatgatggtggccgctgtcgaggcgattttctgtgttgccagcgacgacttcactctcgaccggattgttccgagcctattgaacttccgcgttggcgaagcgggcgccttggcaacagaagcgtcagacgtcgcgggatgagggtcggcaggctggcggcgttgctgctcgccggagtcggagtgtttgtcgcgggcggttgcgcgactgacaggggtgatcgtcatccggagttggtcgttgggtccaagcctgattcggagtccacgctgctagccgccatctatgtcgcggctttgcggtcgtacggttttggggcgcgaggtgaaactggtgctgacccaatggcgatgctggattcgggtggattcactgtcgtccctggattcaccggcaaggtgttgcaaatcttgcagccccgagcagcggtgctttccgctgctcgggtctaccgcgcgatggtctctgcactgcccgagggcatcgccgccggcgactacaccactgccgccgaagataagcccacgctggtcgtgactccggacaccgcgaaggcctggagtggtagtgacttgagcctggtgctcagtcactgtaacgagctggtcgtcgggatcgttgccggcacccacaccccatcggcggtgggctcgtgccggctgcccgccgcgcgtgaatttcctgattatccaactatgttcgccgcgttgagggctggccagctgaccgcgggctggaccaccaccgccaaccccgacctccccgccgacctgattgtgctcaccgacggtaaagccacgctgatccaggccgagaatg

SEQ ID NO: 136 - DNA (genomic), 36138 bp, Mycobacterium leprae; double-stranded, circular
  hypothetical: NO
  anti-sense: NO
cgcacatttaagcacaaggaccaacccggccacagccatgaccagctcaagtcggggctgttgttgttgatggacagcgtcgatgatcttggccacgcggtagtgccgttgcacattgccggtcatcggtccagttacgatgcatgagccgagctgcgccagcagatggtcgagagcgcagcgcaagagcgagctgcgcaacggaggatacggccgactctgttgtttgcgctcacgtgacgctgtacgctcagcattgactgcccgccgtgacgatttaaggagacttagccaccaaactacatcgtgacatcttcactgcccgcggatttactccggtcgcccaatcccgttagggagtaaatcttccggtagatctcgcagatccacccagatttctgcatgtttcgcaattgttttcgatgccgcgacgaaaatcgggcaataaatgcccacagtctaaatacaattcagtatacctgccggatcagatgttcacgggtcgctggcagacgggtgcgagcacgtcgataaagtagataatgatacccagcgcagcagcacacggatcccgtccttccaccagcaccaagaccacaacaccagcgcacgcagcagatcagcatgcacaccagctcgactatgcacggaatgaaccgatcgttacgatggcctcaaccacagcttcgacgcgctgccacaggttgcgacgcaaagtccaacgcaacgtgcctaaacgttcactagcaaaatagcactcaatatcgcgggatcaattgctcggcaagtcctgaacccgacacatcccccaacaagtcaaaatatacttccaacggtggtctcggaccccgacacagccacgacaagacactggcctgggcccgcagctggtcgatatcgagtcatctcgatatattccaaccgctcacgcaatcaaatcgtcgggaaaccaaaaacagtttcagtcttagacgccaacgacagcccggaccgccacacggccgcccgatgtcacactgcttcgaattcgaacccaccctcgccgagcagctcgacggcggagctaacaagcacacaccgtcgccgttctcctgttcttttatgagttcctgataccgtcatgaccaccccctggtgccagtcagcaccatactgcattgccatttcgaccaaaaagccataacatgaagatggcccgcatgccaaatttaatccgtagcgctgtactcggtctgggtgccaacgtggccgttggcgcgatcggcttatactggcttgacgtattgtccccgccctaaccatcagaagcaataccgataccgacggcgggcagctaggtttaactggtgtcaactgaaccaactcagacagcgcccgccatggctaccagctcattcgcgtcagcgggcacatggcaggctaacgaccgactgggcgatcgcccgcacgccgggccaaaccacagcattgctaccgatgatcgcgctgcacggcttaggcggcaacgcatccaatgtgatggccggcggcgtaaagcaaggcctggcgcaaaccgtcaacgcggggttaccacctttggtggtagcctccatcgacggaaactgcatctactgacacaaaaagcttccggcgagaactggccgaactagagtgctaaacgaactcatcccactgcgggcaacgcggcatctcaacacctcacgggtggcgttcttgagctagtcaacagcggctaaggggcactgctgctcagtggctggttagacacccgcacgtaccgcagcgatgggcggtaggcccggcattgtgacttgtccctcagaacagcagcacccggagcattcgacgttcccgatgactggtcggcaaactcagtgttcagactgcccgcgctgacgtccatcccgatccgagttgattgcgacgatagaagatagcgatcagttctaccaggcaaccaaatagttcatagctcaattgccgcacccgcctaccgaaggtttctctcctggcgggcacaacggggggctgctagagctcacagctgccggccgaaccgacctggacggcaccgctgccgattgcctaaggcgctatcacaattagcacttcagcaccgtgtagaatgtaggtgtgccattcgagaatttgatagcgcatgcgatatcaaattcccggacggacgatgcctctcttgcataatcgccgacgtttgggctccggggcagagcgcgcgacaatctgacggtgaagcgctcccttaggactcgcccccttctgtacacctggccacgaaagcctgtcctaaaggcaaacgttgtgtgcacgtcacaaccgctgacttgctaagacaggtcttcggatgctcaccgaaggcggcaacgccgttgatgcagccgccactgccatcagattcaccacggtggaaccggtatctaaataacataagctcggacatcttcgccatcgtctgagagggacagaaattgcacggaatcaacgcttcgaatcgctcttttgctacataaacgccaaagtaattcggcgacaatagttttcctgatcttaaatagaattcggtgaccgtgcctggagtggcaccggtctgggttgaatttgcatgctaaattttgtgaaactattattctagaggattttcgagcttacgatctcccacggccacaacaattttctggcctcatcaacggtcgcggagcaatgggagacacaggtaccgctgtttaatagcccagccgggattcaccgaagcgtttctgcggtccaggcggtagccgaactccggtgagctgttcattttcccgagcaagcagccaacctcgagctgatcggctcaactcacggtgacacgttctagcgcagagaactggcgtacagactcgaggcatatgctacagttaatgttggtattttgtgttccagtggtctggcggctcatcgcaccaactgaagtggcataatcaaaagaaccgaacgcggatgcggtatccacgaaattacagccaaacggtcaggggacagtggcattcagtggcattgatagcactgagaatcctgtaaaaattcgacatgtcttcttttccagaagattccgccgacatcgtgcatctggacaatccaagcagtcaagctgattttcaccgacacgcaggcctatgtagccgatatcgaccacatttcgctgtgacaaaaacgctctgttggatacggagtatatgaaacaacgtgcgacactgatcgaccgcaagcaggcgaaaccggcatccgccagcacccaccaatggtggcaccgtgtacctgacagcccccgacgccgcggggataatgatgtcgatggtccagtcgaactacataggattctgctccggtgtggtggtaccggaaaccggaattccgttgcaaaatcgtagcgcgaatttcttgctgataaaggacataagaaccttgttggacatagcaagcatcacctacacacaatcattcggggccttgttagcaaagacggtgcaccggtgatgggcagcacaatgcagccccagggacacatgcaagttctagtgcttatcgccgaccacgggcaaaatccgcagacagcctacgacggatcgaggttcccactagatgcatagccttcaggccagttgctaaccagatttttcgcagtcaacagctggatgaactgctgcggcgcgggcatgatccggtgaccgtgaactactacccccgggttggggacttacaggcgatttgccgtatcgaaggcgagatatctagcaaaaagggatgcacgccagtacaactaagccgcagctttctaagctttatcttaataatctgccaccgaacaacgcacagtgcagcatttttctctacttctcttaacttcgttgctagatatggatcctgccctttgccgctgaaaatccgatatccttgcgaaaatggctgccgagcaatcgaattgatccgattatgcgatatgcctgggagcgcgccgcagataggtcatccccggtcgccaccaccgatagcacccgcccacctgacgagacgatcacaccatcgtcgcggcgagtggttccagcgtgcaataccccctcgatttcggatccgaagacaatatccccgactcgggggcgtctgggatagttttcggcagctaacactacagccacggcagctcctgaacgccaatgcaattcgccgaagtcagccagcgaaccagttcctgccgcgtagaggagctgaccaagcggtgaatccagcagagccagcacaacttgggtttccggatcgccaaagcggcaattgaattcaacgactgctggcccgctggcagtgacagcaagacccacatacagtagtccgcgaaacggacttccacgttgaaccaattcggctgcaacgggttcgacgatgctggtgagagcctgttgacaaacctcatcgggaagccatggcagcggagcataggcgcccataccgccggtgttaggtcctgtgtcgccttcaccgacccgcttgaaatcttgagccggtaacagcggcaacacagttctaccgtctacgacgcagaatagcgacacctcgggtccatcgagatacgactccagcaataccgggtgtccggcttctaataatcccgcagcatgagtgcgcgcgacatcgcgatccgatgttaccacaacgcccttgccagccgctagacgatcatctttcaccacccaggacaagtcaccgacgggtggcccgaaccggtccagggcggcatccagacgtgctggactattgacgatttcgctccgggaagtgcgcacaccagccgccgccatgacttccttggcgaaggcttttgagccttcgatgcgagcagcgtccttactgggaccgaaacagacgatgccggcagcacgcaccgcatcggccactccaagcaccagtggtagctcgggaccaatgaccaccatgtcggcccggacatcacgagccagagcgacgatatcctctccggagctgatgtcgacgtcatactgttcggccagccgggcggtgccagcgttgccgggagcaacgactaatcccttgacctgcggatctctgctaagtgccagcagcaaggcatgctcacgggcaccggagccaatcaccaggacgcgcacgacacgtcagattagctggaaattactcgaccgttgcgccgggccattcaaacagacccggccgcgtaggagatcgagggcggcagcgtccacaaagaaaatactgtaacacaatgtccatttgcctagcataagtatatgtaaagagttaatcatgctgacatccgagttccagtagtcgggggattgctgatcaaaagccgctgtagtgcccgagttagtgggtcgtggccagcttgtctcgctcagcgcgattttcggcgatatcctgcggaagccccatcgtccgacgctaaactttggattcggcgaacactcgacctagacgagaggtgcagccctcatggaccaattcaccagggtccgatccgacgccgcttcagcacatacccgagatgctgggcgcgacgagacacaccaactactgtcctgctagcaggtgtcgaattattcgttatctagtcagcctggttcagcgcggaggatatgtcgactgctgtatcgcttaccgtcagcatgttgttcctaaggtgattagcatggttgagcacagcatagttgctagcctgatagaccccagcttcagcactcggtgaaaacgcaaagaaccaagacgtgacacgtaaccaggtgtatcccgtcaaggcttcatctacatcagttccgacaccacacactcgaaaaaacgcagcacttggccacacacagctatagatccgtcgatgcacagaaactgcgaatgggacagacacacatatcaccgcataacgtccccccgaccaaccaccatcacggctaatcgcaaacccagagtggtacgaaataacttcagtggcaccgggttaagtgattccgatagaattatatttatgtgacattcgtgcgatcaactcaatgttgtttggcgattggtggcggcttgctacgacggagcattcaacttcctcaacgcagccaacaacctaaactgatctccccactttctcagtaccttccgttagcaacaacgaccgcgcacggcgacgctaactaaccttggacaagcaagaagccaacagcatatcggcgctgcgcggcgtgaccacccccgaattacgcaccactttatgaagcggtgctacccaaactggccaccaccgctaaacaggacatcaacaaaaacacccgagaccccacgcatcataatcatgatgggatcgataccgcgttgcacgccccgctggagtcggaaaaattgctccagcacaacatgctaccggaatccatcatcgtcacaacgacactgagtgagctggaggacaccgccgacaaggtactcaccggctgcggcagcagcttacccatgagtaacgtgatacacctgacacagcaggcccgccatcattcaataaagacctaaagccctggcgatctaccacaccaagcgactagcccccggcacatcgaatcgctgttgtacgccaaggaccgtgactgcaccgcgccgggatacaccgtacccgactactactactactgggaagttcaccacatcaccgcttacaaccacctaccgcaccaccaacatcaacaacctgaccgtttggccgcggcccccaacaccacctcccaaacccagcggctgaaccacacgaaaacacaccaacagcaacacccaatccaatgaatcccaccccccacttagaccacgaccaacccaaaaccaacaccttctgacaccccgaaaactcctgcacgacggaaacgatgatagcccaggtgcggtgtaacgacttgtgtgcacctggcgctgtggggacgcgccacccagacagcacttcgtcatgcatatgctgaggccatggcgacgatcttcaccaaaatcattaaccgcgaactacccggccgcttcgtctacgaggacgacgacgtcgtcgcattcctcactattgagccaatgacacaaggccatacgctagtagtgccatgcgccgagatcgatcagtggcagaacgtggatcctgcgatatttggtcgcgttatagccgtgagtcagctgatcggcaagggcgtatgccgggcgtttaacgccgaacgggccggggtgatcatcgccggatttgaagtaccccatctgcacatccatgtgtttcctacccatagcctgagcaactttagctttgccaacgtcgaccgcaacccgtcaccggaatccctcgacgcagctcaggacaaaatcaaggcagctctaactcagctggcgtgagctggcggtcatcgccatgctaaaacatacgcggacacctcgcttattcgcggcagcgtgacgcagcagcagctctgccccggtgcaagtggtcgcagtaaccacaccaccgtaggcacgcactaaagaatcgacgatcgatcacctcagtacgataccgccattggcccggactcgagatgagtcggtgcgatagagccgctcgaagacccacagcgcctctcctcttgcctgaaccccaggtcaaccatttcgagcacccgcgtcgtcgccatcggtgccgacttggacggtgacgtcgacgcgttccgaggtatgcctataaagcattggcaacaaagttgctcagcacctggcatatccggcgctcatcaccgtgcacctcggggaatcccgggaccgtcgagaacttccgtggtgatcgtgcgattgagggtagattgcctgcgcgtcgtgcacggcatcggtgaccagcgccagcaatctactatacacggtgtgcgagcggccattgcacatccaggcaagcagcaacaaagcgtccaccggcaggcccatccagcttgcttcgctttcgatccgcgacatcaacatggccacgtcacaggcaggcgccctgccgatacaactcagcgaagccgcaggtggtcaacggagtgcgtagttcgtggttgacgctggcgatgaaccgctaaatccggtcatctgaaccacgggccgtctcgacagaagactccgaggacgccagcgcttcctgaatctgggtaagcattccgttgagcaccaacgaaagtcgacccgtcttggtttgggtatcacgttccggaacgcaacggtccagctggcctgcggctgtcaccgcagcggtttattcgacttcagccagcggccgcaggctacggtgcacgaccgcataaccgacaatcccgaccacaaccagcaccggccaccccgatgccgaaccacaactaggccaacgacctgaccctgtgctgaacatcggacagatcgaccacgaccgtgatcaggtcgtgcgacctccgcaccgacaccactcgccactgaatatcagagccgttgaccgatggcagggtcgtcggattaaggtccaaatcattcttggacgaaagtaccggttcagcgttgcggtcgttgatgaccgtaaaggtagtgctgtcgcacaccaatatccccgcacgtaaaactttagacagtggcgagtctaaaactctgaacacaagtgaaatgaacctatgcccaggcttgggatatattgattcggatataattaaccttcggatataattaaccgaagtaaaacacaggatcgaggcgacagcacccccccccgaggtaactaagccacagaccaccagcgctaggacggtggcaaccaagtagacccgcaacgacattccgcgtcaaaattgttgtaatatagcaataatcgtcatacagtcgagtccacatgcgacaactcagtgctgctcccgcaacccgttacttaccccacacaaggtgtgcagcaaccgcttctccctggtgtcgatctggcggcgcagatacaacacataggactccaccatgttgacgggcccaccaaatctataacaccacacgtggtcgaggatgttgggtgtgttcaagactgtgccagcgttaatcacaacacagcgcagcaacgtgaattcggtgggagaaagcgataccaactcgtcggccttccaggcctcgtgggtctcctcgtcgagttcgacatcggcgaaggataggcgggcagtacaaggtgctgctctgcccaaccctgcctttgccgacacggcacagtatgacccgcagcctaatgaccacctcctcgagattgaatggctccgtcaccatagtcgtagctgcctagggtcagaccggcgatctgtactgcagcaagtcgcgcgcgatcaggaacaacgctgggatgtgaatgtcgtcggcgcagccagcgcagcaccccgaaaccgtccatccccggcatcaccacgtccaagatcaccgcgtccggccgagcactacgagcctagtccagctgccgcggctcctttaaacacagcctggacctaaaagccctggaatttgatgtcacctagagcggttcgacaacgttggcttcgtcgtcaacaactaggatacgcccctccagggtggttgcgcttggggtatccggttgccatcagttcacatctgtcgcactcgtttggacgctagcttcgcagtccagtaggtagttcctggaaaccagttaccaaaccggcttgaacgcaatggccagcatgctcagaacgataacgccctgccgtgcaccaaccagctggccagactgctggatggcgatgcaccagttgggacgcccgatcgcatcggacaggccagtggatcgcctactgcgtccgaacgggttaggagatatcttaggtgacaacgcccggcagtttacgcgaccgcctgactgaggaaggcggcggattgcagttcgctgcagctgagcgggctggccgaccggctgctcgccgaagacggactgatcgacaggttgacggtaaaggagggatcaactcgaacagctcaccaactttgccgacactctgggtcgactgatgcccgagatggaagcgctggagcccgctatcgccaccctgcaagacgccgtttccgtgctgaccctggtggtcaacacacccaacaacactacttaacgacgcatgtcactgcagcgctactcacctcggcactcaccgtcctggtcggtgcggtcgcaacgcgtcatcgacgccgacgaatgagcagctaggcttgcaccggttttacgcctccttagctcagtggtagagcactcgccttgtaagcgagcggtcgtcagttcaatcctgacagggggctccaactgtcaatgcacgcgcggtctgagcgcgcagttacggcagccggttagtcagatcggtcgataggccagccaagctgccgcccactacctcgatcacgtcatgagtcaccgcgataaggaactgaacattcgccgcgccgacctcgtcgacactgacttgaaccgcattcataatcgtcgttggatcgccagtgaataagggatgatccaatgttgtagaccgcaaattacggcaccataatcagattatgcgtgtcggcgaacagttcggtaaacaaggacgccggcgagacccctaaacaccagcgttcaaccctgttggttaacgttccgaccgcaatcacaaattagcttgaatacgcgatatcgatgatatgaatattcgtggtgtagatcgggtggaccacgacggtggaatacatcgttttgaagcacactagtaaaggcctagtcaaaaccaccccgctaaaattggtggcacctagcaggtcagcatcgggacaaggaaatctgagagtccaggagcacgagcctacataagatataccaggaccgcgagattgatctactgtaaggcatcgaaaaggccagcgttgatttcattgaacccgaccaacacctgcgagttcattctcagcatgccaaccaacggttaagcggtcttctgcatccttatcaacttcgactcgaagatcccagcaaaggtgccctgcgcacgctagcacgttgacgatggccgcgcccgtagttggcccagctgagtgagttgaactccgagcaccgcagtgtctatcgggcttgccacgttgcccatcgactgctgaggactaccgcagctccggcgacatcgtggccgatcagatcgcagccacacagcgcctcgatggtaggcatcgatcatcacaccgacacctggctgaacgagttaccaatccaagcgtcactgaccgtgggaaacggctaaactcactacaccaacggccccctgcatagacatggggctgcctccgtatccgcatacgatgccgccactgcactcagggcgcgtaccaactgctcgtgatacgcagcccgccgccacccactcagtcgtcgggatgagtgcggccagattgccaaccgccactgaggcaccgatccacgctacatccgctgccgccatctccatgcatgtacggcgccacaagaacaaatgacatcgccgaccctcggtgctatcgggtactaaacgtcatggcggcaaacgtcagaatgcgggcgagaatcgatggaaatgattacgagccactgccccacccgacgagacggggactgagtcgcttgagtacttcagggaaggattgcaagcctcgtttttcaagcaatggaggcataggtacgaagtacgtcgtgtgatcgtcaccttctggtgatgacatcaagatcccgactgcactcacaatgccgtctacgttcttcacgaagccaggactaccactgccggccgacaagctgtacacgctggcttccaccacatcgccgtccatactcttgatggttccgcaagtctcaccggtaatggcaccgaccttgcagaacaacatacctaactgaatctcattttcgctcaacacattccggagaagctggctgtatacatcaccgcttgagtaaccttgactgaggtcaaggagaatgatagcggcatccttcctgtcgccttcgttttcgcttacggtgcgcttgcccagtgggacatctggcccatagggccataccgaaccgtcatacgcgtcgcaatgtccaatggtcaggagataggaactgccgtcgttgcctcgagccacgcaagccgcggtgcaaatgctgctttcatcacagagccggagacccggactcggggcatattcggcgagcaccatactcgcgaataccttcggggcgatgaccgcggcgctggccaatcccaatcctcgcaaccaccgtacggtcgcacacgtctccccggtaaaccagtagattgaacgcatcaaaacacaagattcacttaaatcatgaaccgtttcaggtttaatgccgcttccttcggtgagaaggatggcgattatggccaagcttacccggtcgagtagcgtgagcgcgcggttgaggctagtgctggatcacctcgattcattatcgatcggttcgatccacaccgtttcggatgtttaccgcaccgatgcgccgcttaccaccgtcgactctgcatgagcaccgcaagatagccgtctaaccgtggcgtaaaggccatcaagcggcttggaggactggctgatgcgcgatgacgggtttgtgggattaccccggagccaaaaacaccgcaccacgatcccaggtggcaaagatgcccagcacgccgccgagctactcgaccgtgacttcaccgccacggctcccaaccaccgattgcgagctggcaggtgtacaagactaaagatactgccatgctcaccacagctctccagacgtcactgtggcggcgcaaccatcacggccacagcatcgaagaagatttgattcatcactgcgaatggcaggcagtcagtatgcgtcgatcgtgttcaccgaggcaaccagtccaggcaatccgcttcggaccggcctgccgcgggccctcgacaccgtcggatacccgacgatggactggatcgagcgagtttacaaccgacgcagacgttttctggggttaagtcgacctgttgcgtgagggttatataaacaaaccagcaacacgcgcgtgcgacagatctgccgggcggtgggtgggccctcatgtctggtagtcgtaaaactgcctgctacaagcaggatatcgggattagggcgtttcagtgaggttgccctctggggtgcggtattggacggtgctcaacgaagacctgacgatggtggccacggcgagggcgatgttgcgccatgtccgatttggtcgtgacgattcgaagctgaccacgcggtcgtatacccgggtgcgatcgcattgttcctgagttggtgtgtccgtaccggccagaactggcatggggacgtgggggcactggggttgttcatcacctggctgcggcatgtaggaccgcaagccagcgccgcagttgtggtggatgggcacgtattggctgttccgggcgtctagctggtgcgtggtacatggcggatcaacggtgtgctgaccgccagtgcaggggttcgtcgcccacgcggtgacatccggacaagcgtctggcgagttgatgccactgatctaagagccgactaacaagtgtgatctgcctgaacagaccttcggtgagcaatatcgaatggcctggcggacgcaggcacgacataggttgcacaagccagaggcggcagtgtaccatgccagttacgccgagatggtgacactgttccgggcctctgggtcagctcgggatcgactgatcgtgttattgatttgagtcagggccgttttgcgctgaacccagttatatagactgcagcactctggatgtccatctgctgaccgactcaaagctgctgggctgtgagatgctacggtatacctgaacgaggcggatcgtcagaatccgaacggggcgtgaacaaagtcccgtcgccaggacgtgttactgctggattttccactggtacaggtattcggcgtctacaatttcgagcggtttgcgctgtgacgatcggacaagtcggaattcttgttggtcaacctgtttcgccaaaccaatcggggcgccgatgcggccttggatgcgattaacaaattgatggccgcatgctcgcttcaggcagggattgagtgtgtgacacagcatcgactgctgcacgcgttcgggcagcaacctgaacgacgcgggtgccgtcccgggcgagatcaccgccctgcgggggcatgtgtcgatgagttcgttgcaggtctatctgcatcccgacccaggccgattatgagaagtagtcgagctggtccaacatccgcgcaaatcggcccggggtagactggtaaacaccgcacaagctagctaagtaggccgcccgagcggaccgacatagctacatgtgttcgtcagcgagcgcgtcaaccggcacgccgcggtgattgaacctgccttcttggcgaggccgagcgggacccacgacgacgtgtgctgtcgttcagcaccccaggtagtccgctgctgggctgacctgtgtgtaggttgcggactgttcgacgaccgcacgggcagcgtcgaggatctgcgcctaatgtaagcgtcgactcaccgaacacgagttgtgtaaacacgagatcgtttcactgccatcgcagagtcgccaacggtcggtccgcgaacccgacacctgcatcattgaaggcttcacgcaggaatgaagcttggcgcagtcgggcctgtactcggctcacgccgagcagcaaccgtgcgtttccgggcgtcgacgtcgagcagttcttcacccatcgtcaggggaaacagttgagtcgctggctttgtgcgcggtctccgcgtgcacccaccaaagccgccatcacgacagtcgctactgcgatgcgcaccggcactggcctgggtggtgtgcggccaccacatcgggttgcctgacacgactataggagtcactgcggatgcgtaaagaccgcggcacacacccggcggtgttggggcgagccgatacggaagcgttcctgcaccggctggcctacctggaatcggctgggccgattagcggcgagacccggaagtccgcaccgtgctcacacgcatctccgccataggactgacccgtcccggcgggcgcgccaccggaacgggtcagaactgcacaataaccacgactagcaaactgaggacgtccccagaaatcatgtatcagctctgcacacacctaaatcagctaacctctccagagatacataccgccattgaactggccatcgatcccagataacgcctgaagaaatctgcgaactagactacgactgcctgacccgagccgatgacggacttcccgtactgatctacgacagccacaaggccaaacgacccgcacgccgccttcccatcaacaagcaaatcgccgccgtgattctcatttagagaagcgggtacggactgtctaccctaaaatcgtaatcggcaagctcaaactactgcccaccaaccagcgaatcccggcgggcaccgggcgatcaccgccttcagcttggcgttcgccccaccgaacagatcgaccaaatgccgttgctgcacatcggtgcctgcatcgaatacgacaaagtcaagatactgctctccacctaccgatacagctacgcccaacgccacgccgaagccgacgttcccgtcgaagtgctgggcgaaccaatgtcgcaccgcaaacttgacaccgtcaagtcgtcgaccacgccactgcattgtagttcgaccgacacagcaaccgcatatggcgccagtccacaccttgttggattcctagcacgcccaccgcgccgtcgacaaagtagccgtcccattcagcctctaacaccgaaccgtccaacgttaaggacggacccattccggttccgctgcgccggtcgtgactacttccgcaccgacgtctcctacctgcccgacctacactcctaacgctatgatctgctgcacagccacgaactcctgcgccaccatcgacctcgatgactggacacgtaccgacggggtgccatcagacgaagaggtccgccgtctgatcgactagatccgaaactggcttggcgagttcgaacatggacagcgataacaacttgaacaagccgtcaccgtcgtgtaccgccaccgcagcatcatgcgcggcagacctggttacccgccaaccattcccaacctgcgcccggaaagaaccacatgacgaccaacaccacaccctaccgacgacacgatgatcgacggcctacacagatgccaaccacattctagccgtgctggacaacgccgtcaaagacggcgtagaactcaacgttaccggcattgctcgacgtgccggggtcgaccgcacattcctctactgccaccgctacctgctctaacgaatccacgtcacagaaacccggccaactaccaaacccgacatcaaccctgggtttacccgctctttacggcaaaccgacctgctcgtcacccagcagcgctgcacacgcatggccgcaagcacccaacaactcgagacccacgcctacccgaaattctcggcgaacacgcctggcgcgcaaccggactgggctcacccatcgacatcgacgaattcagcaacgcattgtcactctcgaacaacaaatcgtcgagctacggccgcaactctaaagaacgcgactaagacctcgccgctgcccgcaccgccaaccgcgaaaccatatggaccagctcaacgtctcccagccgaccgactgaaaacaaatgcttacaccacacctgttgccgcaccatatccatcaacagccaaccacgcgaacggcggaaacacagttacactacggcagtcttacaccggaccgtcgagaaacaccggcacagcatcctcgactacgtcccacctgaggaatacgaaaacgcccactaacagtcacgtgcgctcgttccctataggcgatatatctcaagcaggaagccggctacgaaccaagaaagattcaacctgattcagaaaccgggctggactactacgacggggtcacctcaatatttcaaacagaccagcggtatcgcactactcgccgatcagaaaaccatcttcgaacaagatcaaacaatcaaatcgctagctcgctcgccacgatatatggatcccaaccaactcaggatcagcctgctgttccttccgcgaagacatgaccaccaacgcagcacacagcgttatcttatacaaacgcatcgctttgacgtcctaggcacagaacctctcatattcgctatcgaatgccgcgatcacctcatcgtgtccctctaacccagaaatcaaagtctcccgctgagcacggttatcggcaatctctcctggcgacttcattccacacaatgcttctggaatagccccgcgcgatgtcatggatcttaaaggacggtcttcccaggctctagcaagaaggcatcgagccaccggctgaaaattctcggctgtctcggccatccatatcgccgattgacctgaccactgctcttgcagcgcctgatccactccttcaacaactcaaatgtgaaagacatttgataagccaacacctcgaaacggtcgatgaagtatcatagttccctagaaccagcgcagttacataatgctactagagttaatctagtagcattagattaacgtatggcaaactcataactaaggaagtcaaacaggtggccggagttgatcttcagtgatattttctatcaggcatctcttcattcccttcggctgttaacgactgccggcactcgtatcgatgtttgcgatgccggtatcatcttcagttacatcagtggacgttttgggtcttgtggttctcgggtcctcatacgcctcgaccctaaggagcaaatttaagtcgctacaggtcaagaatcttcgagatctgagaggattctgttgggtgaagtgctcgtggaggctgctcgccaccaacttcgacacacagtcgttagccaggagcactaaacctatgattgccgtatccttgatttcacgcatttcttcactgaagttcttcaagtcaaaggctgattgacacaacgccgaggtgtttacgaccacaaaagacatactaactctgcttctcttaaggaaaaccctgcaatgcgtcatttttctctacatcagccaccctcggggttctgaactagacgccatttgggcgattcagtcattgtgccttgcggctttttctgcatgccgtgaatctagatcgtttttgccccattagattcctgccaatggatgattagcaggtggaacagctctccgctcaacgtaggacacgagtgggtaaccaccatcctgtccatttatcgctggaaagctgtaaacatgttcacctggagcgttctcgatagataaagatagatggtcttcgaatccggaagtgccaactttcagcacgaccaatacgtcacctaacgttccaccataagcagatataccgaactgatccagcacctgtggtcccaagccactcaggcaaaccaccatactgcttagcgacataggacccgcgcccagttagcacacttatcgctgcagaggttcttcatcacaagctagcattggagcatcgaattgcaatgttaacactgccttttcggctaaacccggaagtgcgcgcacggtcggctccggccacgcgaatccggctttggcttcgtagagtgcgatatcggtgggctggggactgaagtgcgagaattgggttataagctcggcgatgtcgagcacctagtgcggcagatcccattggggactggagcgcatgctgccaggcacggtgcagcgacttggtggtcccccggtaagttggtagacgtcgcgctgagcgtcagcggccagcttctagcacaactcataataacagcggaacataaccggaggcttcgaaatagaactggcgaatgatccgcaatttcgtcatggctggagcccttgtcttgggtaagctcgtattactccaagccagcacccgacatcccccggaacatcagatgataggcggcggcgcttaccgtaccacccaagccgagccgtattcaccgccaccacggcgcctccttcaccggcacggtacgcattgaaccgggcaccttgcgatcgggatcgccgttgtacttgcaatcgacgcgcacgataccgttcaaagtatagtgtagtgcgccgggctaatctgtagctacgacactagacacgcaagacaacattcactaaaaagaatacactaaatactaaattgaaccacttggtgcatacatcgccgaaatcgtcatgagttcgactatacagtttctctattgcaagtcgggcaacgaaaccgagaaggtccggtaactgatccccacacgggcccgaaagtacaccgctcggttaaaaagatccgatgcgcatccctgaaggggagcatgctcaattgaagcagcggacctgccggctcgttcggcaccacagcaatcaccggatttatcatgacggccgtgctgatgggctacgcagcagcatactcaccagtaaccgaggttatgttggtcgacacgaccgaacgcatgtgagacgcgaatgcgatgtgccccgccgattcagcacactatagcgaagatcaagccaacgcctagtagcaggtcgtcgatgactagatcgcgaagcaaaaggggcgtacgccggaagtaccatccaacccccagtccgtgacctgggatccgcccagctttacgccaaacgtgggaggattggcgtcgtgaatgacgctgatccacaactgggctaccacttccgcgccgactggataaccggcccctggcacatcgaatacctgtactgtcgaggaccccttacgccaacaccggctttgctaactgtgacagatgttgcgtacctggcggccacgctcggtggtgagccgaaaagtgaagtaataagtaatatagtgatcccggagtgcacctctcgttggtgattttcgaatttcgtcaagtccaggttgatctcgacagtattcagagcggtcctggcggcatcagtgccgatgtaggtccggacgtgccaccttaattgggacgtgccaccttaattggtctgtcagtcgccttggatggcagcaatcaacaaatcatcggcgccctgctgtggacccagttggatgaatgatgaatttcgtgccgttgttaatgatgtgataagtaagctccgcagtctgcgaatccatgctcggccgcaatggctaagtgaatcaaacagccagccgcaacactacatacctcatacctcgcagatgcgtgacatcgaccgaggacactgtcatagaagatggcgatgttgacccagaccgcacctggcagaggagtttgctcagcagccgtgaccgatcagttcgcgacgacttcatacagacctagaaacccacgatccgccaacaaggcgatcggaatgaccaatcgcagccccgccggtgtcctgtcccacacccgccggaaaccgtgcaccacagccggcgacggtggtactgggctacctagcgagcacgagttgaggtcgatcaagttagacacctactcctactatggtcaggcccaagaccccggggggtcgtacaaacgctacggggctttagtcaagctatactggtaacgggccagatacagacaggaatttcgccgcatccggtcaggtgattctgcccacatcgaccttcgagagagcccattcgattgggggcttcacagcaagctaccgcatacttgatgccatgctgtctgcgacatcaccgcaaaccgtttatacggtgctaagtggtgcgctcgtaatgagtcgaggtttctgatggcgcgttcccacaatcctcggcaccggcatcgcgccattcataagccgtcgcgaatccgcatagcgctgactcggagcttcatgacgctcacatcgttcgtcgcagtgctgctgactggagccggctattgggtagcccaccgtgcgctagaagacatcaccgtttcgcaagctctcaccacggacgatccgcgatccaccgataacaacataaacatcttgctcataggcttagactcacgcaaagaccagcagggtaatgatctaccttggtcgatcctgaagcagctgcacgctggcgattccaacgacgggggctacaacaccaacaccctgatattggtgcacgtcggtgccgacaacaaagcagtcgcattttcgatcccccgcgatgattgggtgcccttcagcgacgtccccggatacaatcacatcaagatcaaagaggcctacgggctgaccaagcaatatgtcacccagaaactcatcgaccagggtgtcacggatcagaaagagctggagacacaggggcgcgaagccggccgggcagcaaccttgcgcatagtgcgaagcctgaccggcgtgtcgatcgactatttcgccgaggtcaatttagccggtttctatgatctgacccacaccttgggtggtgttgaagtgtgcctcaatcacgccgtctacgactcatattccggtgccgacttcccagccgggcgacaacgactggatgcttcagaagcactcgcgtttgtccggcagcgtcatggcctcgacaatggggaccttgaccgcacccatcgacagcaggcattcatatcctcagtcatgcgggagcttggggacaccggcaccttcaccaacctagacaagctcaggagcttgatggcggtggcgcgcaaagatgtcgtgttatcggcaggttggaacgaagacttgatccaacgattaggaacgctcgcgaacgacgtaggagaaaaccgtacccaattccggacgctgccggtagtacgctatgataacatcaatgggcaagccgttaacattattgacccggtcgctatcaaagctgaggtagcgtcgacgatcggcaccgcctcacccgcaacagcaactcccagcaagccaaatccgtccactgtcgtcgacgtgataaatgccggaagattgaccggactcgccagcgaggtattccaaacgctgaaaaagcacggctacactgcaggtcaggtccgcgaccgcagctcaggcgagccgactaccacctcgatccaatacggcgccggagcagacactgatgcccagaacgtggccaccctgctcagcattgacgcccctaatcaagcggatcctaagttggcatccggacacatccgagtgatcgttgacaccaattattcgttgcccgccgacgaggacagcacaatggacgaaaccatcacttctcagaaggtcggaacatatcctccgtacagctacaacaccagcccttaccctacgcccgaccaagggaaacctatcgacggcggtggcatcccctgcgtcaactagtggcgatcgcaaacacggcgacgccgagcgttaggatcgccactaatcagactactaggcgtaggtacctcgtcgatgtgaatttcagtgccggtgatgaacgtgcctcctaggacgtcctaggacaccggcatggcgatcgacgccaacaacggcagcaggattggccatcccgatgctgctggattgcagcgcagtggacggtataggcatgagcctgagaaacagcgaccaagcagcatctttcgggaggtagcccggcccaacgcagaccgcacgcaaaccctccctcgagtattcgagtgccaatgaatgggtaaaagcctgaataccgaccttgctagccgcgtatgcttccatctacgggcgcgcaaaagatgccgaagtggagctgaaatgcacaatcgcgctgcgcgaattcggcgagtagcgtcggcagtacttcgcggaccaccaggaaagtaccggtcccgggttgaggggatgattcgattccactgctgcgtgctgatttgaggagtgtgagctgcacccaagattctggctagcgttaatcaatgaatccaagccgaggaacgtttcaactgcccagcgtacgccctcgatgacggaatcctccttaacgacatctatatctggatagtggtcagctggttgccgattgccgcctcatcggccgagcacgggtacttgatcagcccgtccgccggcgatgtcgcggcccctaccacagtggccccctcgtccagcagccgcaacacggtggcttgaccgatacccgacgccgcaccggtccctagggtccgataacctgcgagacgcctcggatagcacattcttcatctttcaccaagcctcggaaaacccggcatggtggatgacatgaacatctaatttatcagcctggggagcatgggcagcggcatggctgccaagctgttgaaagccggtcaccaggtcaccgtctacaaccggttcacccgacaaaggcggaatccctcgttcggcaaggcgcgacggcggcacgcagccgaagccagcagtggtgcggttgttttctctatgttctccgactatcgggccggtcgaggacatggcgtttggccaagacagaattgtgaactttgctagcccctggcgccacccaattatctcatcgagcaccatcagcgtcgcgctgttggagcgcccgacggccgcgcacgctgaagccggtcagcagcgtataccggcgggcaccggtgttctacagaaccgaagcctcctctaaggcaaaacttttcgtgatagccgcgggcgacccggaagctctagagccgctgcgccccgctgttcgacactatcggccagcagaccttcgtggtatccgaccaaccgcataccgtcaccttggtgaagttgagcggaaacttcctgcttacgtcgaccattgaagcagtcggcgaggccgtcgcgctggtcgccaaggcagtagtcgacaagctgcagttgacatcctcgcctcaacgttgttcaccgtgctggcgtatcagacctacggcgggctgatcgcgctacaggaattcgagccggccggattcgtagcgaaactcagcctcaaagacgggaggccggtgttcaccagcgcatcagacctgcagatgccgctccccggagccagtttactgcacggccgcctgcttagcctggcggcaaccagcaacagacacctggactggtctgccgtcactacgctcacctaccgcgacaccggcacggcgtccaccccagactcacaccatcccacttagaccgtcggcgccgaacacgagttccaacatcgcagagaagttgagaccgcgtcgcaatatctgcccgccgccgacattgatgacttacccggtgattcaactggccacatcgctgagcaaaacattgctaggttggcgatgtcatcgacctcacccatccgtggcaacggtgtgcagattcggtaatcccgcgttccgctccggcgaatcagtcacgggctagaattagatccgtgcggaccaagtctgggcgaaaataccgttgcccctcacccacgacgagccgagctcatcgacaggccaacatcaacatgtgatcaacaggcgacttggtgaccccgtaggcgccaaaccaacagggggttttactggccagcgacggaccaattccgacgaatgaaccagcaccaccgtgcatcactaacctgccacgtacttgagcatgtatctggccccgttgatatccagggctacggtacgtcgccacgcctacagagtcaatctggctagatcggcccgatggccttccgagccggcccgcacaatgcaccccacaccatgcagccaaccgtgccaaaccgtcgcggcatccaccacacgggcgttttcgtcttcaccggttctgtcggcggtcgcacagcgaatcgagccgccgttgagcctcgagtccttgtatgctgttgacagccgctaccagccggttagtgtcgccccgacgatcgtgacggcggccccggccgcgacaagtccgcggccagggccggtaaacatgtagtaatatccgattcttctaaagaaagctgcacctggttcccttacgcccaaactaaaagcaggttctcgcaatagaaacatgtggcccgcccgtagctgctacggcacagcgtggcaagcccacttacgccagcttagcggtgcgccagtcctccacatcgggcggcaggccaaccggaggtaccggctctcgttgtgggctgaccaataggcgtacccaaggctcgtgcatgtggaagttatgccgcagcgcctcggtgaatctcatagcatcgaaggcagcgttgaccgagtatcttgatcagcagcgtcactatcgtgggccgttcggcgacgcggagggcgaactcgagcgtcttggcctgcccagctcattgagcaggaaaaccgtggacaccatgcccagccgataggcctcgtcggtatccaaacgcatcgcctatcaacagcagctttttgaccttaagcggaccaaattcccaagggtgagcgtaatattcgacgcacgtaatactcatgcacaccgcaaccacatcgctgaacttcagcgttatcagcagcaacaatcagatcgcatgcccagatcagcatcaagcctgcaaatatccgcgtcgccctgaacctggatggtggtgactttacgcaggtcacgccagcgacaggtgttttagaattaatgtagtgcccctcccgcagatttaggtcttctctgcgaccgcatcgcgggtagcatcgtgtgaacggaaggccggatgttgcaccggtccgagcttgtgttccaataactccgggtccgagcccgagtcgtgaccagcggaaagattcctgctgcgcgccgccaaaatcaccacacgaacggcgccgtcagcctcggtgtggcaaaacgcctcatcaagttgaaacagctaaggtatagttctgcgcgttgtgaacgccggaccggttgaaccagatccgcgcgatgcgatcgccatcgagagtcttctagaccaccaaaactcttttgtttgttgatttggccggaaattgtcattcggcctacctcacttatcaggatcgctgcatacccggcccccggtcctttgcacattagcagccaacacccagagcgttcgccgccaggttgatcggtgtcagtagctgcaaatcttcaccatgccaacagttcctccaacatcgaacagtccgaccgtgtaccccgacctgctctacccgtcggttccgacggcacaccactacggctgattaagtgccgctgccagaagagccgcggcagtcctgagtaaggccacgagacgggcatgttctgcgttctgttgcttcgactggtcaattggggagaatttgctcggaagccacggctgaaccgtcgttgtcaatatcgctcctgcacagccgctcgtaccctgtctcagggatggtgttaccgagcgtgtctgccaccacccgaatcgccatccgttccatgtcatagcggtcgtgaaccgaagcgattgtccgcccctccttgcgatgtgacgcaaaattgacccgttttgcgacccaggctgataccgcccgcgtcatctcttagtctgccacctctacgccagcgctgaaggccactgcttgctgtcagtccaactgctggcccaactccgattcacactggcgaaacccagtttaccactgggccagttaagcttcctgccaagctagctcagccttatgctgcgcaacctgcacttcgggctgggcaagctgcacttcccgacggcgaagctgagctaactgctgaggaagcagggctccccactgagcgagttgagcttccagatgggaaagttgcgcttcgtgctggtaaatataggaatcttgtactggacgacctggccttcgtgattaaacatggcagtttctcgctcggtcagcgcaacttctcggttgcggagccccatcctggttgcgcagttcagcgttccgattgcggaactccacgtcttcctcgatatgtcgagtccgctcctgctcggccaagtcgatgaagacaccgacttcttgctcactgtaacagcgcttgccaatgtacgacctcgagaaggcgatattgttgggcatcggctggaatgaggatcattgttttttcctcccggagttttgagcgccatcaggcgagtctccatgccgtttaggatattattttcccgcagcacagttctttacttgccactgactgacaagcatcagctcaaaccgacaaacgtgcggcaggctacgggaagtgcgtcagacaaccagttgttcgcgcttggaccgtcgcgtttttcgacctcggcaccggtcaaagcacctgccgtcagctgtgcggcagtcgtccaccccagggccgatagccacccagttgcacgccctcaacaaaacggcatcacggatgcctcgaattagctaggagatcgatctcaatcgcgtcctgaccgtgtcgacattgacagcctgcccagaatctcggcgatctgtgccgtacactcagccaggcgtgatttgcctggcttgagtcggtatcggcaccagccggtccctgattgtccacctcctcccctggccactaatctgaccatgataaacgctaaaattcatgcgacaggctgcgacgcagtacgcgttacccttacagttaagtaatgtctacgaaatctgaccctggcgaaatcgacgacgtcgagccactggccgacagcacggcaagccaggccaggcgcgtcgtcgccgcgtatgccaacgacgcggacgagtgccggattttcctatctatgctcggcattgggccagcgaaacacgagacgtaaatgacttcgcggggtaaccatggctcgaagacctcaagtgacaagcacctcggggattccgactttgtagtggtcgccaatcgcctgccagttgatcaggtgcgacttcccgatggcactgcgatctggaagcgcagtccaggcgggttggtcacagcgctagagccgctgctgcgtcagcggcgcggggcctgggtcggctggccgggcgtaataaacgacaacgtggacctcgacttgaccatcaagtcgatcgtgcaggatggccttactctttatccggtacggctgaacacacatgatgtcgccgagtactacgaggggttctcgaacgccacgctgtggccgctataccacgacgtcatcgtaaagcccatttaccactgcgaatggtgggaacgctacgtcgatgtcaaccggcgcttcgccgaaacaacgtcacgcacagccgcctacggtgggaccgtatgggtgcaggactaccaactgcaattggtaccgaagatgctgcgcataatgcggcccgacttgaccatcggtttcttcttgcacatcccgttcccgccggtggagctgttcatgcagataccatggcgcaccgagatcatcgagggtctgctcggggccgacctagtgggattccatctgaccagcggtgcgcagaatttcctgttcctgtcccgacatctgctcggcgctaacacgtcgcgcggattggttggtgtgcgatcacggttcggtgaagtgcaattgaagtcccacacagtccaagtgggcgcgtttcccatctcgatcgactccaaagaaatcgaccaagccacccgcgaccgcaacgtccggcgccgcgcccgcgaaatccgggctgagctaggtaacccccgcaaaatcctgctcggcgttgaccgactcgactacaccaagggcatcgatgttcgattgagggccttcgctgaactgctcgccgagggtcgggcgaagcgcgacgacaccgttctagtccagctagcgacaccgagccgcgaacgagtagaaagctataagattttacgcaacgacatcgaacgccaagttggccatatcaacggcgaatacggcgaggtcggtcatcccgtggtgcactacttgcaccgcccaattccccgcgacgagctcatcgcgttctacgtggcaagtgatgtcatgttggtcaccccgctgcgggacgggatgaacctagtggccaaggaatacgtcgcgtgccgcaacgatctcggcggtgcgctcgtcctcagcgaattcaccggagcagccgcggaactccggcaggcctatctagtcaacccacacgacctagaaggggttaaggacacgatcgaagcggcgctcaaccagctggccgaagaagcacggcgccggatgcggtcgctgcgacgccaagtgctcgcccatgacgtcgatcgctgggcgcgatcatttctcgacgcgctcgccgaagcgccggcgcgcgacgcgacataacttgcatctctatgtcacttcccaccgtggtgttgtcgccgaaacgctatggatactcaattgcagcgcgaacagaggcgcgccgtgccatacatccgtcgcggggttggccactggtgctgtcatcctcacgaccgttgcactcggaattgcattgcaatccgccgatcccgaaagtgccgttggcccaccgccggacggcacctacaacttcaaccaagccggtgtctccgcggttatctgggaacataaccacattgtgtgaccagccatccgaaacccgaaaccaagccaattattccaatcctgtcacctgggcgttccgatgtactccgaatgtgggatgagtcagacacttgagtagataacccgtgtcgaccgactgcagaaattcagcgccaggactcggttggctagcgtgctttggattttccagttgagacaacccgacggcacaccgtgtccgaacggggcggcaccttaccgtccaccgaaacgcattcgtccgatgacgtcacgctcggctagttacgcataccactttgatacggtgcagcctgcggccagagattaaatcaagcaaccgttctcgttgcagttaggcgaaaccgccccagcccaacattatccattttgtactgcaataatattgccacgtgttattgagccgagttaggcacggccaaactatgtgttgtcaatcccgcccggccagtaaccagtaacttgtccgtttagacttcaaggtgtcgtcgtgatggtcatttggtggttattttttgctggtttggtttgggtggtgttgtggtgggctggtggggtgtgggtggttgatctgcgctagaaggttgccgtatgtgccgccgacggccggatcatcgatgcactgttcactaacacgatactgctgcacccggcggcatgcctgcttgctggctgagggccggtcaacaagccgccgacaccgataccagcggcagaaatggtgcaagggataacatcaggtgcgaatagttataccgtgcacggggacgtgcctgttcaggtgcggccacattgaccacgccgacacctcaaggccatgacatgcacactaaaacgcccctaccccgcggcgctaacaactatcctcacactcacgcctgcatcgatatcgccttcagcacagcccaggtgcccagcccctggcatcatcaacatgtagaccaagcagcacccaccaccgacatgcttacgtgcgccgcgctaatcgtgtccactgcggcaaagcacacgaagcctcatcgaaagcaggcagtcagccacccaccaacaaaaaccccgcaacacagcaaaacacgtcaacaggattccgggctgccccccacgactaccgaacatatcggccagtcataaaacgcaaaaacagccatttcacccaccacctatgaaaccaaccgaacaactcaccgccacagacacaagacagcagagcccgggaaccgcacgatttttgacgccactcaggccaagttggcaaccacgtggtaggacctagatgctcgacaaccgtgaacgactggactcgctgacggatggttgccagattgaacacccggttaattctcgcaacactgtccagcccgattgctcacaccggacacgccagattggcttacgccctatactagaacggcgggtccttagcaatctccctgctaataacgctgttgcagaaaatgtagccatcgaaccattacaaccccgcgacggcaaaggcgactgctaccctcacgggggcgaccagccctgcgggccgagggcccgcagggctggtctaaagttagcctatgcatggggaaagccaacctaatactgccactgccgaaagcctcgtcaacattaggctgtaattgatgaaaactcccccggccgagcaaaagagccgcgcggggcggctagcacgagaaaaattcactataacagtggaccgtcagcactgacagtacgatactctatgatgtggcgacatcggcgaagtatccatctgcaaaggccgtgccccagatcgctgtgggctctaccgcgacgagggaggctgcccgtcgggcagtatacgtgccggccagttcgcggacggcaattaccatggccgccgccgcgttggacctgaccagcaaacacagcagcccggcccagacactgcttgtccgtgcaggacgattcggtctagctacacgaacgtcagcagcgcacccggcgacattgcgtggtccagacgttgggccggaagtcgaggatgcgactggagaacgtgcgtagcgttgctgggatgtcgatgacgccaggcactgcccacagatactcatccctggtggtcacttgctggccaagccttgctgccagccgtcgatcacgaacagcgaaaagggcttacccgcaggcggtgacccaagtgcccggcgtcagcactcgccacgaaaatggacgtcccaataggccggatatcggtgcgacgccggcgtgcatggcaaaccgttctagccgggtgtctcgccacggatggataccgcagttcaaccgctgctgcgacggacaatgtctttcggcgacctatcttcacgatcggtcagcctaattaaccggacttggcgaaccggcgcactaacgccgtgcgatcgacctttccgatgccacgtcgtggcagtgtatcaacgatgtgtagctcgcgcggtgcggccatggcgtccagtctgcgggtgacatgtgcccgcaacatgctcagcgtcggcgttgcgtaaccgtcagtcagtaccactgcggctactacccgctgacctagccggtcgtcagtaagcccgaacaccgcacagtcgctgaccgcgggatgggtgcacagcgcagcttcgacgggtcctggcagcacggttagcccacccgtgctgatcgcgtcgtcggcccgacccagcactgttagcacacccgagccatcgacagtaccgaggtcgtctgtgtggaaccaacccgattcggcgaacgggtcgggaacgatcggattgcgatagcccttggccaaggtcgcaccaccgatcgctacgtggccattgaccagtacgcgtatgcacacaccatccagcgggacgccgtcgtaaacgcaacctcccgcagtctcgctcatcccataggtgccgaccaccatgatgccggcagatgttgcggcatccaggatcggccggggagctggtccgccaccaacgaggacggcatccaattcggctagcacggccgtggccgttgagtcggtgagcgccttggccagctgggtagcgaccagtgacgtgtatcgtcgaccggtacccaatcgacccaccgcgtccggcagtttggcgaggtcaaacccggcagaaatgtccaactcgatgggtaccgaaccggccagcacgctacgcaccagcacctgaagcccgccgatatgatacggcggcaaagccagcagccagctgcccggaccaccaaggcggtcgtgggtggccgacgcgctggcagtcaaggcggcggcagtcagcaaggcgcccttgggcacacctgtcgttcccgacgtggtggccactaaagccacatcgtcgtcgatctcttcacctactcgcaaagcacgcagcgcagcgatgggttcatgctgagccggtaccacgaccattgcgggagcgcggccatccaggattcgttccagcgtgggcagcaacaatggagctgcggaacccgacgtaacgctaagcgagcgaaggacggctatgtgggttctccgttgtcccgtgcgttatcgagcagccagcccttggcgttcaaccgtgtccgtacccgttcgatgtcctgcggggacggcagctcgtcggttaggtggctgatcattacaccgatgtcgatcttgtcaaattcgccgcgccgtatcagctctctggcgacgagtttcacttcgtcgttggtcaatcggcgggctagcagcgcgagcaccgcgaaagtatcggtcgctgggatgccttccggatatcccgcgcgcagccacgaaacgattgaagtaaggaatcggttcactttgctgcaattctgcgcagtcggtacaattagggcttaattcccaggaacgggtaatgggtgtgatgagcgatgaagtctctgctgacgatgtaaagcaccccgaggatgaccaccataagaaccagcgcgtagatcacccaagcgagtgtaacgaggattggcttgcggtgtggagtggcgttgttggtgctagcgtctccagcgtcgttgacttgcagccggatcccgagcgcgaacagccccggcaatgccgcaccggccagcgtgctgaaaagaaggatcttgagggtggcctcgtagttgaaccaagggctcaagaggcgttccttacgccaaccgtgtggtgactagagcggtagcgaggcagggtagcactcaatttagggcccacatcagagtgtggcttatgttcgtccgaaccgtcgagtccagcggtcaagctgccttcccagttttcattgacgttcttgtggtcgaccttgaccttacgcgaccggatgtagatggcgacagaggccgcgaccaacagcgagaaccctatgaccgcgccgggataaccaccgattagatgcacgatccagtaggtgactgctcccaccgaaccagccaacggaagcgtgaccagccacgcggtggccatccgaccagccacgccccaccgaacctcgccgccgggtttgcccaacccgctgcccagcaccgaaccagtgcagacttgggtcgtggacaacgcgtaaccaaagtgtgcggacaacagaatgaccgcggccgaggatgattcggcggccattccttgcggtggcttgatctccaccatccccttgcccaaagtgcggatgattcgccagccgcccaggtaggtacccgcggcaatggctatagcgcaacacacgatcacccacagcggcggcgtggaagcggtcttgctgactgttccataggacatcagagccaggaagatcacgcccatcgtcttctgtgcgtcgttggtcccgtgtgcaagtgaaactagcgacgccgagccgatctggccgcgccgaaacctggtgtcggtgctcatagctggaacactgcgagtgatcgcgtagaccaaccaggtggccaccgccccaacaacgatggccagcaacgcggcaataatggccggaataatcaccttggatatgacaccgctccagatcaccccgtgaccgccgacagcagcgatcctggcgccgacgataccgccaatcagtgcgtgcgaggaactcgacgggataccgagaagccaggtcagcaaattccagacgataccgccgaccaggccggcgaacaccagttccagcgttaccagatccgcctcgatcagatccttggcaatcgtggctgcgactgcggtagacaagaacgcgccgaccaggttcaaaatggcagagaagaacaccgccacctttggtgcgagcgcaccactggcgatcgaggtcgccatggcgttcccggtgtcgtgaaaaccgttggtgaagtcgaaggccagtgccgtgatcacgacaatgatcaagaggaacaaattgatgttcacagcgcctgattctcgtggtctgggcaatccattgtcgaattaactgttgcatgaatcgcaggtaagctgcgacccagcgccaaatgttaccgtgcaattaatccggtgttctggggcgttcactccttgtgtcccggcgtagcgggtgattggcaggaacctctacaaagatcaaggtaatctcgtccgggtcggtcacatgcatctcgtgtaagccccacggttcccgacgcggttcgcgggtgatggagacgccgcggccttccaggtcggcttgggttacggcgatgtcgcggacctgcagccacagcgcaccgggaaaggccccccgggagtggtccggtgccccctgaatgacatagccggctagttcgagaagcgactgtccggcgaaaaagactgtgcctgtaccatattcgcgggcaatcgccaacccgatctgatcccggtagaagctcagcgaccgttgatagtctgtcggtcggagcagcatccggctggccaggatctccatggcctttgtgtctaccacgtattgacgatagtgattttagtcgcgcacttgcttcgcagaggatccaccgctgggcccagtgaggtcgtcgcacgcgatctgccagccagggcaagcagcagcgatagcaatgagccctcgaccttctcgcccactttgtgctgcagtcgtggtcggtgacgtagaagacgagtctagcgatccggcttttcgaacctatgatgaacgtgttcgagccattgtatccattgtatgaagtcaatcacctggcgcactgagtttggtgtgtaggtgtgtgggatgcccaactggcgaaggacattggcgccgtgtactgaccacctcgccagaccaagaagctgtggatcccggcggtgctgaggtggaattctgtaggccacggaactcgttctaagatagcaaccggactctaagatagcaaccggactcagtgccgctatggttggcgatctgaccaatggtgaacttatcgaagctgaaaccggctttggtcatgcccagcgggcgggtggctggcttcagcgaggcaatggcctataggtacgcaacgatatcgtgcaccgtccaagctgctgtacagtgatggcgtgtcccatcggtactacgtgatattgacgagggcgtcgcgctcggtactacaa

SEQ ID NO: 137 - DNA (genomic), 40123 bp, Mycobacterium leprae; double-stranded, circular
  hypothetical: NO
  anti-sense: NO
ctaagtgagcctactgcgtcagctgcgaattggcttcacgtcattgttgagctcgatgtcttccagcttgttgcggcagatcaccggttattgtattggtgactgacagggactcccacgaccgtatgtcgtgaacttaacttctgcgcgttaacgtagcatgagctggcgaagtcgggatcttcttcgccgatcgcgctggtgctgataacgattgcatcgtaggggttttcggtgcagtcgacaaaaaacaacaggtagattttgtccaagaattggaagctgtgtaccgttgtctacaatggtgactacacttgccattgactttcagttacgtggcaggccagctccaaacatacgtccatcgtatcggcacgaacgtcaaacaacatgtctccgtatgttcgctgagcaggtgtgctgtagtctggccagttctggacgagtggatgcagttctgtgggcctagagccgccaaacagtcgattccaggcgtcagaacagattcggagtcaccagtgataagtggttggtagcttcgcgaagctattacgcagattaatccggaccgttcagacagcgtgtcgtgcacagttgcctcgccgctaatgtcgatggtgactccaaggaagatcgcggtagacgtcaccggcgcaagtatggattgcagctgaaacggagttactatgccgacccttgcgtcgaccacgtcgtcaccgacagccatgatgttgggcatgccggctagcgctgcagacctctgcgaattcatcaacgcgtccccctcgccgtttcatgtctgcgctaccgtggccggtcggctactcgacgccggttacgccgaactcagtgaggtcgagcgttggccggaccatccgggccgatacttcatcgtccgcgctggctctctggtcgcttggagtgcgggtcagggcgtcaaggcacacgccccgtttcgcatagtgggtgcgcataccgacagcccgaatttgcgagtaaagcagcatccggacctgctggtcgccggctggcgggtggtcgcattgcagccctatgggggagcttggctcaactcctggctggatcgcgatctgggtgtcagtgggcggttatcggtgcgctcagcgggtaaaggttccgagatcaccgatcggcttgttcggatagacgatccgattctgcgggtgccgcagttggccatccatttagccgaggatcgcaagtcgctcaccttggatccgcagcgtcatgtaaacgcggtatggggtgtcggcgacaaagctgggtcgttgttggagtacgttgctgagcgcaccggagtggctgtggccgacgtgttggctgtcgacttgatgacgcatgatctggtcccgtcgatggtgatcggtgccgatgccaacctgctcagtgcaccccggctggataaccaggtcagctgctatgcgggcatggaggctttactggcctcggtgccgcacgactgcctccccgtgttggcgctctttgaccatgaggaagtgggttcgacctcagaccgtggtgcacggtcaaacctgctgagcactgttttggaacgtatcgtgctagcggccggtggcggccgggacgactacctgcgacggttgcccgcttcgctgttggtctcagccgatatggcgcacgccacccacccgaattacccggagtgtcacgaacccagccatctcattgaggtcaacgcgggcccggtgctcaaggtgcacccgaatctgcggtatgccaccgatgggcgcacggcagctgcgttcgaggtggcctgccagcaagccggggtcagattgcagcgttacgagcaccgcgccgaccggccgtgtggttcgacgatcgggccactggcttcggctcggaccggtattcccaccgtcgatgtcggtgctgcccaacttgcgatgcactcggcacgggaattgatgggtgctcacgacgtggctgtctactctgccgcgctgcaggcgttcttttctgccgatttgttctaaaggcataggttctgctgatatagcgctcaacgtggagatggtcacattccagtgcggcgatccagcgaaggtagcccgttggggtcgtgcactaacgtgcagctggccgcacgttagacgacggcgggccactaattagaggccaaagagcgggcggcagccgtcgaagccctgcacttgcacttcgacggtgtaatgctgctgccaattgtcgtgggtcagtcggaaccgcagctgctcggccagagcttcctcgtgtgctacgttgttgtcttgttagccgttatggcgctgaggttactatctgcgtgccgagcctggaaaacacgaaatacaatgcagtagaatttatttcggagaatatagccttggtgttgctggatagtcttaatcatgatccggactatactttgtgaacgatcgggatgtccttcgtgtttaggtcctggatgccgaccgcttttccttctatgacaacggtgagcggcagagcccggcaatccggtttgaacccggccagtttctgtcgaggtgcgagagggtgttgaaaggcacctcctcgccaggcatttgcgtccagggatcgagaaatggcatcagttcagggttgtgcacttcctcgggaaggtgtcgatcagctgttcacacagccttcgttaggtagccgtaactgtaatcgctaggtggtcatccgcaggtcgaacagttgtcagtgacgagatatcgctccattatctggaccacgctgggcagtaccacctgatttttgttgcgggtctcccacgcgagctaaggcgacggagaatctagactagctgcgtgacttatccggtttgggcaggctcacacgcgtgattgacaccgttgaatatgctgctaccacccccgaccagccgcaaccgtttgctgagctgggcctcagagaggacgagtaccagcgagttcgcgaaattctaggtcggcgacctacggacaccgagctggcgatgtattcggtgatgtggagtgagcactgttcgtacaagtcttccaaagttcacctgcgttacttcggtgaaaccaccaccgaggagatgcgtaccggaatgctggccggtatcggtgaaaatgctggtgttgtcgacatcggtgacggctgggccgtcactttcaaggtagaatcgcacaaccacccttcttatgtcgagccgtaccagggggccgcaaccggcgtcggcggcatcgtacgtgacatcatggcgatgggcgcgcgacctgtcgctgtgatggaccagcttcggttcggtgctgccgatgcgctcgatacccgccgcgtgctggatggcgtggtccgcggtattggcggctacggcaactcgctgggcttgcccaacatcggcggcgagactgtcttcgactcgtgctacgacggcaatcctctggtgaatgcgttgtgtgtcggggtgttacgccaggaggatcttcatttggcgtttgcctcgggtgcgggtaacaagatcattctgttcggcgcgtgtaccgggctggacggtatcggcggggtctcggtgttggcgtcggacaccttcgatgctgaaggagcgcggaagaaactcccgtcggttcaggtgggtgacccctttatggaaaaggtactcatcgagtgctgtctggaattgtatgctggcgggctggtgatcggcatccaagacttaggaggtgcaggattatcttgtgccacttcggagttggcatcagctggggacgtcggaatggcgattcaactcgacaccgtcccgcgccgcgcgaaggatatgacgcccgccgaggtgttctgcagcgaatcgcaggagcgcatgtgcgcggtggttgcaccggagaacgtggacgccttcttggcggtctgccgcaaatgggaggtgctggccacggtgattggtgaggtcaccgacggcgaccgactacggatcacctggcacggcgagacagtcgtcgacgtgccaccgcgcaccgtggcccatgagggaccggtgtatcagcgacccgtctcccgccccgaatcacaggaagccttgaacgcggattcatcgaaaggattgccgcgaccggttagcggagacgagctgcgtgcgactttgcttgcactgctgggtagtccgcacttgtgcagccgggctttcatcaccgagcagtatgatcggtatgtgcgcggcaacaccgtcttggccgagcatgccgacgctggcgtgctgcgtatcgacgagtccaccggccgcggtattgcgttgtcgaccgacgcgtctggacgctatacccggctagatccctatgccggtgcccaactggcgctggccgaggcgtaccgcaacgtggctgtcaccggtgccaccccggtcgcggtgaccaactgcctcaacttcggttcacccgaagatccaggagtgatgtggcagttcgcgcaggctgtgcgggggctggctgatggttgtgcggccctgaagattcctgtaaccggcggcaacgtcagcttttacaatcaaacgggggcggtggcgatcttgcccacgccggtggttggggtgctcggcgtcctggataacgtggctagacgtatccacacgtccttaggcactgaacctggagagattctgatgttgctgggtgacacctatgacgagttcgacgggtccgtctgggcgcaagtgatggctggccacctgggtgggctgccgcccatggtggacttggcgcgtgagaagctgctggccgaggtgctgagttcggcgtcgcgcgacgagctggtatcggcagctcatgacctgtccgaaggcggcctcgcccaggctatcgtggaatcggcgttggcgggtgaaactggttgccgtatagcgcttcccgaagatgctgatccgttcgtgatgctcttttccgaatcagcaggtcgggtgctggtagctgtgccacgccccgaagagagccggtttcggtcgatgtgcgaggcgcgaggtttgccagctatgcgtatcggtgtggtcgatcagggttcggactcgatagaggttcggggtcaattcaccgtgtccctggcagaactgcgtatgacgttcgaggcggtgctgccgcgatttttcggataagttgggccgcgaaaaattgaggttagcgtggtggaacggcttcaagtgcccgtagttgcttgtcggagcaagctacactgaatgttacatttatgtaaagccaattaatcatggaaggggttggcaccttcggtgcatagactcagggccgcggagcatccgcggccggattatgttcttctgcacatcagcgacacgcatcttatttcggacggctctctctacggggcggtcgacgccgacagccggctcggcgaactgctcgagcagttaaagcactcccaactgcgtcccgacgcaatcatctttaccggcgatttggccgatcggggcgagccagaggcataccgaaagcttcgatgcttggttgagtcgttcgctaccgagctggatgccgaactcttctgggtgatgggcaaccatgataaccgggtagcattacgcacgttgttgctggatgaggcgccctccatggcgccgttggatggcgtacgcagggtcgacggactacgggtcatcaccttggatacgtcggtgccgggacgtcattacggagaaatcagtgcatcgcaattagattggcttgccgacgagttgacaacctcagcaccggatggcaccatcctggccttacaccatccgccgattccaagtgtcttagacatggccgtaacggtggaactacgcgaccaggcttcgcttgggcgggtgctcaagggtagcgatattcgtgccattttggccggtcacctgcattactcgacgaatgccaccttcgtcggaattccggtatcagtcgcctcggcgacctgctacactcaagatctaacagttgtcgccggcggagcgcgcggtcgagatggtgctcagggctgcaatcttgtgcacgtctaccaagatacagtggtgcactctgttattccacttgggatcggaaacatggtgggcacctttgtttctcctgcgcaggcgcgacgcgatatcgccgaaagcgggctgtttatcgagccgtctgggcgggattcgctgtttgcccatcctccaatggtgctgacaccgtcggtgacgcaaagtcttggcgattgaagtccgtggcgaccttttcccagggtgccggtattggaaagtagcgttccagaaaactgacgacccgttcggcacgctccgttgcggggacttcggggaaactaccgtcgttgaggcagaaaaagtcgtagttgcgacgtttccgcagttcgggaagtaagttgaggcctgtgtacgaagtggtgtccacgtacagaactttggctttttcttgttggacagcgcgtccagttatcagcgcgtagtaatggtagagcgaattggtaacagatatatctgttccggaccggaacacactttcctgggtccgagcgaattcttccgggaattcttgttccatctcgaacagcacgctcttgcgtagcggaaccgtggtgtgttctagatgacgcgtaatcagttgtccaaatcgccgtaagaggagttggcggttaacccgggccgcattctcgaagccactgcgcgttggatcgttagtgcctaatcctatacgggtcttggcttcgatgaacctggtcactccgcccggggagaagaacatgcttgctttgagtgggcgaccgaaaaacatgtcgtcattggagtacaggaaatgctcgctgaggtcgggtatccggtgtagctggctttccaccgcgtgtgagttgtaggttggcaatgccgacctatctgaaaaatggtcctccgcggggacaattgtgatcattgggtgatcggctaaccatgacggcgggatcgaatctgtcgcgatgaagatgcgccggatccatggagcaaacatgttcaccgaccgcaaggcgtatttcaactcgtcgatctgtcggatccgcgcgtcggcgtcgtcgccttcacctactacgtggtgcgacatttcggctgcccgacgtgctcgaaattctggatcactaccgtcgacccacgagaacaccagatcgatgtcaaacgtgacgtcactcgcgtgcggggtgaacatcccctcaatggtatgccatttgtacccgtagagcttgatggtagccggtgttacttctttgcgtggtagcactttgcgggtcagggagttttccaccgggcagcggatcagggtctcctcgaaggaccagaactgcagttcgacaccgaacctcgaaccgaaccgaaatcctcccggtgcaatccttcgtcgatacaaccgcacgatgcgtggatcgatcgactgcgataattgacctttggccactagcacgggagaaagcccgcgttcgtctattgttttggcgtacataggttcgctggcacacgcggtgacgagcgcgcgttcgaccgcggggcgcagtttgatgttgatggcaagaacgggccggtttttgtggttgcggataaataggaaaggaatatcagcccggttcaacgcctttcgcagaaagatcaaatcttcgatctgtgcttcgtgcggggtcaaactggactcgagccgggcaacctttccctgccgggtaacaatgatgggttcaagggtgcgccgcacgggccgatcgtcttcgcatgaaacaatcttgctcatcgaaacaccgccttagtgaaatagtctaaccacggcaccgagggaatctcacagaccacacatcggcgcaggactaggtattctggggatacgcaggcaacggggtctcgcaatctatatggtgccggctggtcgatatctcttgcaaaacagcaaggcttagttacctgcgggcaaccgttcggttacaactatgccatatcaaatttagtttcgagtggaagaattctcgcttcactatcctcagtctagcgcaggggtatgcgggactgtcgtggcagtgggttgatgtacgccagggcccatggtctgggtctttcgggggcgtccagattcaggcgttattggcttgttacggttgaattcgccgcagcatagaaattttcacgggttgatggtgtttgtcacccaatgggcggacctacacgtattcgaccgctagcggtgaaccgggctcgaagtgtgttgtatggggctaagttcacgccggtgtacggcacgagcaggggcatgccagggttcacgggtgatccgtttgccaacagctcggtttgctactggagccacccccgggcgttggttcggggcaggttctccagagaggtgtacgggttaagcgacccggcactggcgcccgaagcgttggctcccagcgcgtagctgttattgtcgagcgtgttgtgcacgcttgggcgcgacttcggcgaaattgcgaatggtgcaaaaatttcgggaccataccatgttaggcagctggctgaagatgcccagatcgagggtaccacgcgccaggtatgactcgctctgttcgaatatctattccgcccatgttgccgaatccggtagccgctaacagcacgtcatccagatagcgttgctggtggttgatggtgtgcgccgtggtcattgcctggctaatagcaacccacacgtccggtgcggcgttggggtaaatggtcacccagttccgccagccgttgtttttttagcctggttttggggtagctggaggttcacgtcatcgaggagcacgttgccgtcgatgagtgtggcaccgaccttgtcgcccagcctgctcggtgcttcggcggctgcgttcagtgtcaggttcagcttgaccggatcaaccttctcgatgatttccgttgacgtatcgaacaacctaattgatctccgtggtggtcgacgtcgcgtcaatcacttggggtggagtgatgggtagcagcggtgcggactgcggcgacgtgaacgaaacgtacttaccaccgaacacggtggctaccttgatgttgaccacgaggttccctgggattagcccgaggttcttaggatccatctccagcatgaatttggtcgccaggtaccgtctggttctctctcggagatgctggtcacccggccgatctcggccttgtggtaggtgactgtatgaatctggagctatcatcaaactcgcccgtgaatccactgccgtcaactgcgtcttcagcgtcacatcctcacgaagtcgcaaataaatgtacgctcagcacgataaatgctatcattttagtgacactaggccgatgcccttgtatggattgggtgcgaccccaaacaacgacgcatccatgatgctgagactctaggctatggccgtttgtgatagagccgatccggcaaagactcggcaagccgtccttgcgcttgcggactggctgaaggacagaaccttgccggcgcccgaccgggacgctgtggctacggcggttcggcttactgtgcgcaccctggcgacgctggcccccggggccagcgtcgaggtccggatcccgccgtacgtggcggtgcagtgtgtttctggacccagccacactcgtgggacgccacccaatgtcgtcgagactgattcgcggacgtggctgctggttgcgaccgggctgatgcagctagtggaggcggtggcgaccggtgcgctgcgtatgtctggctcgcgtgccggtgacatcgaggtgtggatgccattaatcaatctacgctgtacgtagttggctaaactgtgtgtttggctgtcggggtaggtgtccgggcacctaaacacgtgccacagattcgtcgactgggccgtgctggccgtagactccgttgcgtcaccaactgcgccctagggagctgcccaatcgtgaccgtccagcaacccgggcgggatttcagctcgccccgcgaagagtgcggtgtgttcggggtctgggctccgggtgaactagtcgccaaactcacttatttcggtctatacgcgttgcagcatcgcggccaggaagctgcggggatcgctgtcgctgatggatcgcaggtgttggtcttcaaagaccttggcttagttagtcaagtgttcgacgagcagacattggcggcgatggagggtcacgttgccatcggtcattgccgctactccaccaccggcgacaccacctgggaaaatgcccagcctgttttccgcaacatcgctgccggatccggggttgcgttggggcacaacggaaacctggtcaacactgccgagcttgccgcacgtgcccgcgacgcggggttgatagcaaaacgctgcccggccccagcgacaacggactccgacatcctgggcgcgctgttagcccacggtgcggccgactcgaccctggaacaggctgcgctggaactgctgccgaccgtgcggggtgcgttctgcctgacattcatggacgaaaacaccctctatgcctgccgggacccgtatggagtacggccgctgtcgctcggacgactggatcgcggctgggtggtggcttctgaaacggcggggctcgacattgtcggcgcctcgtttgtccgcgacatcgagccgggcgaattgctggcgatcgacgccgacggagtacggtccactcgtttcgccaaccctacgcccaagggttgtgtttttgagtacgtttacctggcacggcccgacagcacgctggccggacggtcggtgcacggcactcgggtggagatcggtcgtcgacttgcccgcgaatgcccggtcgaggccgacttggtgatcggtgtgcccgaatcaggcactcccgccgcagtgggatacgcgcaggaatccggcatctcttacgggcagggtctgatgaagaatgcatatgttggacgcacattcatccaaccgtcgcaaaccatccgtcaactgggcatccggctgaagctcaatccgcttaaagaggtaatccgcggcaagcggctgattgttgtcgacgactcggttgtgcgggggaacacccaacgcgctctggtgcggatgctgcgcgaggccggtgccgtcgagctgcacgtgcgcatcgcttcaccaccggtgaagtggccctgtttttacggcatcgacttcccatcgccggccgaattgatcgctaacgtcgtcgcagacgaggaggagatgctcgaggcggtacggcagggcatcggtgccgacacactgggctacatctcgctgcggggcatgattgcggcttccgagcagcccgcttcgcggctgtgttacgcttgctttgacggtaggtatccgatcgagctgcccagtgaagccatgttaggcaaaaatgtcatcgagcacatgcttgccaatgcggcgcgtggagccgggctacgcgatcttgctgctgatcaggtcccagtcgatgcggacgaaaattgcgtttggcgttgacacgatgtgagtcccggcagcacggggtgcttggtgggcaaccgttcaaatgtagtacctgattccgactgtgagtgacgaccggtagcctttatcgcgatgatggatcccggaaaaagccccggagccagctgggcaatcatggcatcacctatgcgtcgacaggggtggacattgaagccggtgaccgctcggtcgagttgttcaagccgatggcagttaaggccatcagaaccgaggtgcttggaggtctaggaggattcgctgggttgttcgctctacgcagcggctaccgcgaaccggtgttagcggcttccaccgacggtgttggtaccaagctggcagtcgctcaggcgatggataagcacgccaccgttggcttggacctggtggcgatggtggtcgacgacctggtggtctgtggcgctgagccactgtttttgcaggactacattgctgtcggccgaacggtgccggaacgactgagcgcgatcgtcgacggtattgccgaggggtgcatgctcgcgggctgtgcgttactgggtggtgagaccgcagaacaccctggtctgatggaagtcgaccactacgacatcgcggcgaccggcgtcggtgttgtggaagccgacgatacctggggccagatcgtgtcaaacccggtgacgtaatcatcgcgctgaggtcttcgggtctccattccaacggatactcgctggctcgctcggtcctactcgagatcgatcggatgaacctggccggttatgtggaggagttcggtcgcaccctgggcgaagagctattggagcccacccgcatctacgccaaggactgtctggcattggcggccgaaactcacgtccgtaccttctgtcacgttaccggcggcgggctggccggcaatcttcaacgcgttatcccacacggattggtcgccgaagttgaccgcggcacgtggacacctgcaccggtgttcgccatgatagcccagcgtggcagggtcgcgcgtgaagagatggaaaagacgttcaacatgggcgtcggcatgatcgccgtggtcgcgcctgaagatactgaccgtgctttggcgatattgaccgcacgtcacttggactgctgggtgctgggcactgtctgcaaaggcagcaaagtaggcccacgggcaaaactggtcggacaacacccgagattctaatgaactgcgcttaactgaaacgaacagtaacactaaaactaacactaacaccgtgccgatgcggaatacatcggcacgacagagttgggagtgctagcggcgccaggcgtcctcatcccatgagtcttcactcacccggtcgtctccgtccagctggccgggatcggcggcacctgtacttgatagctcgcgctgaagccgctggaagtcggtctgcggggagctgtatttaagttctcgagcaaccttggtctgcttcgccttagcacgtcctcggcccatgggggaaccccctcgcgtcgcgaaataacggaacggtctagcaagtagacggctccgatcacttggtgtcgttattattgtcctgccgacagtttaccgtgccttgcggcaggcgttgccgtcccctccccgcttgtggcggacgactccaagtgtagtcttgaactcatcgtccgcgtaaccgctcgatggccagccgtcccacgccaatctcgtcggctgctggcaatgagtcgggatcgatcaccgctgcgactgacccgtcttgcgggccttccagttcgatagtcagttcggtgtcggtcggcagcccacgtttcagcagcgccagcgccaccggtccgaggtccacgtgctcgactacggttccgagtcgtccgacggcgccactgttggccagcaccgcatcgcccgtcgaggtccgttccaccgagccgtcgagatgtaacaacaccagcatccgaggcggtttgcccaagttttgcacccgtgcgacggtctcttggccgcgatagcagcctttgtccagatgcacggcaccttcgccgggaccaccgatccaacccacttcgtgcggtatggtacgctgatcggtgtcgacgccgagccgtgggcggagcgctgctacgcggtgggcttcataggcccacatcccggcggaccggacgcccacccccgccaaacggctctgccagtcggccgactcacgacgcggtaccagtaggtccagttcgatctggcctgcaggggcgccgggtatccggcgcacgaagctcccagcggtcagcggaaccgccgtcgactcgtcgggcagcgcatccagataaagcgcattgtgcaccgcttgctcagtcagtcgtggacccagaagtgacagcatggccatgtcggcgctgcccggggttacctcggaccagaacaccatcttgcgcaggtactccagcagcggctcaccccgccagggttcggtatcgagataagtggtaccccccagttcagtctgtatccagtggtcctcaacccggccttgactgtcaaggctgagattctgcgtgctagcaccatcggggagtgcacttacatgctgggtggatatgctatgcagccaggtttgccggtcactgcctatcaacgtgagcgtcgctcggtgtgagcggtccactagcacagcatcggtttcagccgaccgttgttcgcccagcggatcgccgaagtgccagatagcgcccgcgtcgggtccgggatcgggtgcgaggactgcgttcacgtgcgtcgctctcccccgcaagcgggaagtacccccacctcatcgcttcgctttgcatcgtcgtcggcgcggttcacgcttcaaatgtacaggctggccgacgagcgtgaaggctagctacccgttgtggttgacgcacttgcagttcgccgcacgtgcgcggtgcgggccatttagactccaaaattaattatttcattttattaatgttatttttgtttcacgtcgggtgtgatagtcgcgttggacggcgagatccatacgccgggaacgttgctgttgcacgccgacgaactcgccgtagtgtgcggttacgggcgtctttgagacgctgtatgttccgcgacggcctggcttgtctggtcgagccgcatctgtagcggctcacttgatggacctacccgagctggacttgccgcactggcggcatgcgatcgacgtggccgcgcaacgatggattgtgactattgtattattttgtattattttatttatgaaggtgcgctgtgattgatctacagccacgcagccaggagatcggctctgcgctgacgacctacgtagtggttaaccctctgtttggtcgcgggtggaggcgttgcggcgcgccggggggtggcggtcacattggatcgtgggttgcccgccactggcgccgccgcaacgctttggttgctggtcagtgctaaacactgtcgtacgcagcagaatatggctgctctgcgcgcacgtcgctcgacggtatgctggtgacgttattttcgtcagctcgaatggactacgtcctgaaaggccgcactcgacggtggtgctagccacgagtgttgcaggcaggacggacggtaatttttgcctgctgaagccggggtggtatcccatcgtccggcgtactactcaaacagctcctcttcgagctggtccgcgccgagtggtacgactgtgactatcgaacgttacagatcgccgacctccatgaatcacggggatctggttgatatcaagcatgaccttgattgcctgaggatacacacttgacggccgacgactgccgtgctcaccgatggctgcagcattcgtcgaactgatcgacagcgctatcgtctagccaccgcttaggcggtcaaattctcttgtgagtagaaccccggtgtgcgggtacggtcggccgtaagctaggaagttaggtagcccgcgaaattgatagcttcatggatatatgcgctggctgcattagcttgcgaagagctggcatcggcgcgctggcgaatgccccgcagtcagtcgcccccgagcttccggtcttgtccaaccagtagttacgctaagagaccgctctatttatttcatggattcgtaaggcgagagatgcgctattgtttgacgttgatggccatcttttgagctgtctgactgtattggttggtaacattcacagcgcaggtctcgacatcgaacaccgcattaagcacgcgttggcaggagggccgagtgggactgccgggcatgtggacctgagtaattgtgaggggcgtctctagtgaggtcactgaacgtccagtgaaagtcctttgccttgttcggtggccggcatcggggtttggccggagcaagccgcggcctcgtagacccgtagggtgttgtcccgcagcgtgcaactgctggctgcgtactgccttgttgttgctgctagcatagacacgtgcttagatggtaggttcgaacgcgtcgaggcactccaggtttgacaaggttccggcggttgcgcccagctactgggtctggttcatgatttccatcgatgcgatgcttgtgtaacggcgacgacgtctgttggaataagaaacgattccaggcggccaggagccggcgctgttgtagtatgtgctgaccgaacgtcgacggcctcttggggcgatgcttgggtgaacgagcacaaccaccaccatgattgcaacgatggcggctaggctcgcgacgccgatagtcatcaaccgcttgttggacgcggtaccagttgccactggcagtcggtacgtgaggaggccgatgcaccgggtcggctaacacccggggtgctcccgccaagctgcgtagggctcgtgggcttgttgtcggaagtctgagtggcctgtggttgtcccttggcatcggacagttcggctgactcgatggacgccaacacgtggtcgatcttggttcgggtgcgataggtcacgtcgtgtcgaaaccgcagtatgcgcaggagttggccgatatcgcttcgaacgctggggtcatagccgtcctcgacaagtccgatcgtgagttcgaccagcagttaaatctgttgctgagggttgagtcctttttccgccagagtgttacccaaccgcgtttttgtagcaaaaggcaccggcggctcgtcggacagctggtccggtaacggcacgggggtggcacgtagcgcgtgcaccgcggtcactaattgaatcttgttgaatcttgaatgccggcgtcaacggtggggttggcgtagttgatgatctgcaacgtggtaaggggattcacgcgcatgttgtcaaccgaaccaatccgaacgggaagggagagtggccgcttcaaagcttgtgtagattgtagccagtctgactgggcttgtattgtagccaattacttgacagcgcgacgatgaacacgtcgttggattaggatctgcgcgcggagtatactccatcagaataagacgtcgtcaccggtgagctcgtggtcgcaccaagcctgttgttggctccgccgaagtagtggtgtgcggtcctccactgttgacctgtcgtgaattcgagtagctgataaacagcgccataacactctcctaaacaaggcgcagcaagcacggcgaatacgtgatttgatgctgggcatggtactccgcgcagtaaatggcttcggcaattgccatgcccgattccgcgagcaggtcatcagctaatcacagagttggatccattacctctcaatgtggtttagcgtgtggcaggaattcgacgtagcgacgtgcgcactcgtcgctgggaacggaccattgttcgttgttgtggaccccgtgccactcagtctctgtccgctgcggtaagtggcctgacggtctccccggcctgcactgggttcgttccggcaccactggctgtcgctggcctactttgtagttaggtgtcgcggaagaggtcgtcgcgcactgaccatatcttgccgtcgtcctgaaccgtacaagtctccggcgtcggtccgcatcgtgtgtacggagtttgatcgccaggtccacggggtgtctgtcgccgctattcggttagcgtcccgactcgagtgaaggattgccacagtgaacgtggccgaaagctgagttggcgcaggctccacaggctagctgccaaactgtgtactgcggcctcgacaagatccggcttaactttccgaccaagatccagtcaccagcttgtcatggattcgggggcattgtagcggataggaccatactttcagctgttgtgccggtagtagcgaccccagtcctcgtgttcaatgcgtgctccgctcattgcggagtagggggcaaaggcccatgatagaaagttgtcctcgtgtgaagcattcggccgaccccttttcctagactatcggctgctcagacgtcgaacagtacacacagcgttatcgtgtgaaggtgtcttcttcctagctggccaggccgctatccggcgaatcggtacagtctcgccgataaatttggcaccaatccgccgtcggcatccactcgttcttcgacataggcgaggtcgccaccttcgacgataccgtaaagccgtttggcgccgccgacgagcacgccggatttgctgcatgctagggcatcagtgaccaattcccacgatgatgcgttgcgtggccgcccgtaaaacaattctacgtaaccagccgaatgggctaacagcaattcgatcgcctgagattcggtaggatcatatggatcgctgacaaaacgccagaaacccgtctcacgtaagctagtttcctggtattcgccagcgtcgttgagccgccaggacctggcttcccaattcaggtagttaccaccgtcgtgcgagaccacgatctgctggccgaagtggtagtcgccattaggtccacgaccctccccttcaccgcgccacacaccgaccagcggtagcagtgccagcaaagtgctattgaggttagcgccttcgcgtagattcgcggtgtcggagggaactggcaagtcgtcgaaagccgggatgttgcgggctgcgctcaccgtagatcgcttggccgcttgaaacatcccagcggccgtacacttgttgcccttgctggagtccgccggactgcccgctccgtcacggacctcgtcggaggtcacgtgcaccgctctccctcgcaagcgggtggaggtacctcccacttgtgggggccgaccaccaccttatcgctgcgttctacatcgtcgccggcgcgggtcacgactcgtcagtgacgagccggtacagcgtataaagcgtgaaccatgagatgaccaccactgccacaaccagcatgatctcgaaaaagagtaccacggggacgattctattcgtcttattggtcgatggtggtttccggggcaggtctgttgggctggtcaggtgatcttgacgtcgaccttgtggatgcctgttcccgaaggtgacatcatggcgtcgccattacctactgaagacagcgcgcgcagtgtccaggaccccggcgcggcgaaaaaccggaagtcaccggtggccgaggtgaccacttcggccgtgaactcgttggacgaatccagcaggcggacgaacgccccacccacggcttgccctttgcgatcgaccacgcgaccggtgatcaccgtttctttctcgaggttcacgttggcgggcaacgccagtctttgtttaggctcagagcacatgtcagcttcccaattcgattgggacacccaccagggagccgtattctgtccaactgccgtcgtagttcttgacgttttgatatccgagtaactcgcgcagcacgaaccaggtgtgtgatgatcgttcaccgattcggcagtagacgattgtctctttcaacctatccaggccggcgtcggcatacagcttggctaactgctcgtcggatttgaaggtgccgtcctcattggccgccttgctccaaggtatgtttatcgcactggggatgtggccgggtcgctggctctgctcctgaggtaggtgcgcaggtgccaggagctttccggagaattcgtcgggggaacgtacgtcgacgagatttttgatcttgatggatgctatgacctcgtcccgaaaggcccggatagtgttgtccggtgctgcagcagcgtaggaggtcgccggcctggtgacggtgtcggtggacagcgggcgaccgtcgagctcccacttcttgcggccaccgtcaagcaatttgactttgtcatgcctgtacagcttgaaataccaatacgcataggctgcgaaccagttgttgttgccgccgtacagaatcacggtgttgtcattggaaatgcctcggtcacccaacaatttggagaattgctgggtgtcgatgaagtcgcgcttgatcgggtcttgcaaatccgcacgccaatccaacttgatggcgccggcgatgtgatcgccgtcgtaggtgcttgtgtcctcgtccacttcgacgaagacgatgttcgcgctgtcgaggttgctctcggcccagtcggcagagaccaggacatcagagcgtgccatggttagagtcctttcacttaccttggggtggtcaaccagggttacggttacgtggagcggcagtgcgtcgaaaccacaccacaaccgggtagagctgacagcccagacagatgccgaacgctgcgttgaggaaagcggccactaatgcagctgccgtagcgatgactcccaccaagaaagcgccggcggcgaatccggtaacaccgcaaaccacgaagacgaagccgagcagttgggcgaactttaacggtggcaccggttcgcgctctttcaccggacccagccgaggcgccacgagggcggcgaacacccgtccgtatgggtgccggcgcgggccgccgagagtgcccgtggcaaaaactacggcctgcaggaccaacagtaacgcggccgccagcggactgaccaccgaaatgatcaggacggtctgcagaactgcggccgtaacccatgcagcaaatcgtggtccgcgaacatcgacgacctctactccggtggtggtgttattgatcgtcactgttctactcctaggtactcctgttgcacgtgttgcacggacaaagtgggagacaggccacggtaggctccgagtgcggcgcgaaagagcttggctacttcagcagctacaggaacaacccgtgatttggcacagatggactgcgcaacgcttggtgagcctgggctcgaggcaggttgacacgttagccagcttacccaatgacacgctaattaagccaacaatggttcgagtgtggatagcagatcaaaggccttggggactcccgacgtccggtatcgttgctgtccgtcggtatcgaaaatcaatgtggtgggcagcgaaagcaccgaaaatcggcgcacagccgcagggttagtgtccaaatcgatctcgatatgggctacgtcgggcaggtctttgcagacttgataaaccacgcgacggacccggtcgcacggtccgcaccacggcgcgctgaaatgtacgatggttggcccagtacgcgacaagccgaggtcagcggtgtctgtgccagtgccttggcccggcccggaacaaatttcgtgaacgtttcctgagtgtcgagtcagccaccgtccggtaaaggctgtcagcatgcccaccgttattgtcgctacaatcgcggtcatcatgagtgttgctctcccggtgtttccacccacttgtagaggacgtgcccccacgtcatcgtcatcgctttgctctgcatcgtcgctggcacgcatcatgattgcttaaacccgtcgagggtgattgttactccctgtgtgatgccttcgatgatcacatccgagccacgcgctccctcgctggtcggtgctaccccgaatggaagccgctggtcggacatcctggcgctgaaggcacgtagtacggggtttcgtttgtcatccggaacgggttggttggcggtgtcgggtccggtcgcaatgcctgtaggggtaaacaccagcgtagcctgatcttcaggggcgatggagaggtccaccaagacgctgacccggtggtcgaagttggccgatttcggtgtgccgctaagtaccagcccatggccgctggagatcccagactcggtggtaccgccggtggcgttgttggtttcccggtgtggtgcctcgaccatgaggtcgctgatgcctagatactggcccaggtgcatcgaatcgatgatgatgcgactctctagcctgtctactgggagcttcgcatcgggcttgatcagccaggacgcgtaggtcaggtcgatcgagtacatggtggcttcgagggaggccttgccgaccatggcgtggtcgactgcgttggccttgatttccaactcggtgtagtggtcccgcatcgcctgcgggatgaacgggaacgccagtatggcgacaaatgggtccgacccgagatttgctgcgttgcgcacgttcactgacaggaggtattcggcgtagatgctggttccgtaatcgatgccgaggacaccgacaacgagcacagccatggtgaccaccgttgcgatcacactggttagcaccttgcgcatacgcatattgtgacgtacctttatgcaggttgcatctttaaccatctccgaccagcggcatgattattcccgaaacgccttgtcgtcgggtctataagacttagtggcacgttattgtgctatagacctagcactcaaacagtgcgtgtcactatgcggtttgggaaattccttttccacgacacttggggttgttggagctactatatattgtattgatctcggagatacatcccgacccggtgtgccgtcgttgtcgctgctgccccacaccgtgcggacggtgctggcaggaccgtcctcgttgcttaaggacggagcagcggatgccgtgctcgtcgacacgctacaatattattgtttgcacgcggtttgtcttgcctgctgagcagggcgagccgctcggccttgatcttagcgttggatgagtgaaggccggctggtggcgatcagtcctacttgggggctggaagagatcctcttgcccagtaccggttccgcgaagattgatgcccagttatggctggttgtctgttgccgtggtagattctccgaccaggagaccgcgggataaagtcagcctgggcgagctggtcgtcgatgaaggcgatatacaccgcacgactgcctgggtgcccacttcatcatctcacttccaaagagttcgagctgctggagtacttggcacagttagccggccgggtgttcacccccgcgcagctattgcatgaggtggtggggtaggactttttggcgggacccgggctgtcgatgtgtacgtgcgttgactgtgggcaagacttgggcgcgaacatgaagcactgatcggtatggtacgcaatgtgggttacaaggcggtccagccggtgctcggctgtgcgacgatcgcggggccctacgatcaggacatcaaacctgacgatttcgatcacccgatggtcgactcgttacatagtcagtgatggtacttaactggcgtttcgcactttccgccgatgagcagcggttagtgcgcgagattatttcggcggcaaccgaattcgatgaggtatcacccgttggagagcaggtgttgcgggaactcggctacgaccgcaccgagcaccttctggtcacggattcgagaccctacgcaccgattatcggctatctcaatctcagctcgccacgtgatgcgggcgttgctatggccgagttggtggtgcatccgcgggagcgccgtcgcggtgttggcgccgcaatggtacgtgcggcgctggcgaagaccggggggcgcaacaggttttgggcgcacggcacgctagcatcggcccgggcaactgcgtctgtgctgggtctggtaccggtacgtgaactggtgcagatgcaacgttcgctgcgaactatccctgacccgatggtccccgatcagttgggggtgtgggtacggacctacgtgggtacggttgatgacgctgagttgttacgggtcaacaacgccgcgtttgccggccatccggaacagggcggttggactgcaacccagttagcggagcgccgcagcgaaccgtggtttgacccggcgggcttattcttggctttcggtgactcctcgagcaaccaaccgggcaaactattgggtttccactggaccaaggtgcatgcagctcacccaggcctaggtgaggtctatgtcctaggcgtcgacccgtccgctcagggccgtggcctgggacagatgttgacatcgatcggtatcgcttcgctggcgcagcggcttgttgggccttcggccgaacccaccgtgatgctctatgtggaatcggacaacgtcgccgcggcgcggacctacgagcggctaggctttaccacgtacagtgttgacactgcttacgcactagcccggatcgatgactgagcgaaagcccagtttcatgcagtattcaccggtgttgttcaccccaatagcgatgtttctgggttcctgcggtgcatactttccgggtgaccaggccactttgcgctcggccagcggtgcgggtgtgcgtcgaaagtgcgctgagaaagcgagatcggtgaaccacgacaaggtatgcagggcgtttgcgatggtgttgacgacggcggtcaccgccggggtgttatccgcgtgcggtagtgacgtcaatcgcggccatactgcgacaacatccatctcagggaaatcggctgacaccgcggcttgcggcggcaaaagaacaatgacggctgaagggtcgaccgctcaacagaacgcgatcgcattgtttaatcagatttggggaaagttgtgccctgacaagaccgtgtcatacaacccgactgggtcgggtgctggtcgtgagcaattcattgccggccgtatcgacttcgctggctcggactcaccgctgcttgcggatcaactcggcccggccgccaaacgctgtaaaggcaacccggcctgggatctgccgctggtgttcggtccggttgcgttggtttacaacctgccaggcgttcaaatgttgaccgtcaatagtgacgtgttggccaaaatcttcagtggcgtgattacgacatggaacgacgggatactggcggctctcaatccaggtgttgtcctgcccaacctcaggatcatgccgatctatcgggcggatgcatcgggaaccaccgacaacttgcagaagtatttgacgaccgatgcaccacagagctgggccaaaggggtcggtgccgagtttcagggcggtgttggcgaaggggtccagaagtcggctggtgtaatccaggcggtgcagactactccaggcgcctttggttatgttgagaagagcttcgctgatcgggctggattgccgttcgcccagattgacaccggcagtggcggcgtaccgcttaccgacgacacggcacgcaatggcataaacgcagccaacttcgtgtccgtcggcaacgacctagtactggacctgaacgcgatgtacagcaccgaacagtctaatgcttacccgttggtcttggccacatatgaaatcgtctgctcgaaaggctacgatccggacacgtttgcggcgatcaagtcattcctcaccgtggcagccaatgacggtcaggccggtcttgcagcggtcggctatgtcccgctgcccgatacaattaaaaaacgactggtcagcgcgatcaatgcaatgcagtagcaaattgtctctgtgcgacatcttttctcaagcgggcaacaggcggtttaaaagtgacggcagaaataacagggatgggattacggttacaacgccaacctaagcctatgcgggttcggtggtatccatgcccctctcgaagttgccgatcgcactaataagctcgtgggcggcggccgaacttgggagaccagagatttcgcaggctgttgtggagggttccggagtccggattgtggtcatagccgtggtaggcgcgttattgctgtgtcgcgcgatacccgcgttgcggcgcgacaaagagaacttcttcagctacagcggcacgtgggtcattgccgatatctccgtgatgaacttcggaatctttgatctgctgcaggtgacggtgttggtgtcactgttcgcattgatcttggtgatgtcgactgcttcgggagtcgctctgttcatcacccagtatgcaccgcggcgggtagtcggcgcggtggcttattcggtcgatttgttggccgtagtgccctcgatcatttgtggtgtctggggttggtacgtactggcaccgcagctgtgtccgatcacaacttggctcgatcgaactctggtctgatgcattctcttagccagtggcaatatgtcattggcaggtgtcggcactatcttcaccgctggttattgttttggccacggtcgtattgctaggcctagtacgcgccctgggggcgatggtcgcactgctgatcatcttgcacagcactcagaaaacgtttggttaaccgccattccatggcggttacacctttgcaacccagattgtcgccatcgcatcggcattcgatgatcgatacaaggctggtccttatattgctgcccggctggggcttttcattagtcgccttcgtgatcgatgtctcagtgcgtagtgttgtcgccggaattagaagacgaaattgatgacttcgatcctggaccggtcgttcaaggaagggacgttctccgggcttggtcgatgtcgtcgagttgtgaacagcttcgtgactgtaatcgtgacattgctcgtcttgacgtagttcgtggttggcggtggcgcgtatcacgtgatcgtcggcaccttgttgcagggattgatatgcactgcaatttccatgccgattgtcttcatggtcgggatctatctggttgaatacggtagtggtacaacgctggcgcacgctagctacatccatgatggatatcctaagtgttctattctagatcgtggtggcactgttctcatatacgtactgtgtgtggcgacgttgggtcttgtttgtgccaagttcatgatggcgttggtgttgttgatgctcccggtagatcgactgggctaccgagaaaatgctgcaaatcgttccgatggatctgcacgaggccagttacactccaaaggttccgaagggaaaaagattgctataattgtgattccgaagtcgctatctggaattgttaccgaaatcatgttggtgttagctcgagtgatgggggagatggccccactgctgatcctggttggctattcgcaggaaatcaactttggcattttcagagggttcatagggtcactgcccggcatgatgtgtgaccaaacttcggccgatgttgacaacaacacggttaacacggatcggctgtagggcgccgcgctgaccccgataatcgttgtgcttaattaatacttaaatatcgggtccagagtaaccgagaaaatgttcgtccctaagaaattgtaggcaggagaaccaagtggccaagagattggatctcaaaggcgtcaacatttattacggatcttttcaagcagttttggatgtgtcgctggcggtactgcccagaagcgtgacggcgttcatcggagcctcaggctgcggcaagacgacggtgttgcgcaccttaaatcggatgcatgaggtcgtccctggcgcccgtgttgagggcaccgtgttactcgacgatgaagacatttatgccccgggtatcgatcccgtcggtgtgcgacgggcgatcgggatggtgttccagcggcccaacccgttccccgccatgtcaattcgcgataacgtggtggccggtttgaagctgcaaggcgtgcgtaatcgtaaggtgcttgatgataccgcagaatactttttgcgcggtacgaatctgtgggatgaggtcaaggaccgattggataagcctggcggtggactgtccggggggcagcagcaacggctgtgtatcgctcgggccattgccgtgcaaccagacgtgttactcatggacgagccgtgctcctcgctcgatcccatttcgacgatggctatcgaagaactgatcggtgaattgaaacaggagtacaccattgtaatagttacccacaacatgcagcaggcggcgcgggtgagcgatcagactgcgttcttcaacttggaagccgtaggaagacccggccggctggtggagatagatgacaccgagaaaatcttttccaatccgaccgaaaaggccactgaggactacatctccggccgcttcggctagttcatagaaacggccgggcaaaccacttagcgtgagcctggcaccgtgtcgtcttccggaaaactgccggtagcctggaagatgactcggcgtgccacttcaacggcgtggtcggcgaaacgttcatagaacctgcctagcaacgtcacgtcgacggcggccgccacgccgtgcttccattcgcgatccatcagcaccgagaataaatgccggtgcagctcgtccatcgcgtcgtctttttcgcggatctgggcagctttctccgggtcgcgggacaacaccacttcttgtgcaccgttacccaattcgactgcaactcgacctatttcggcaaaatatccattgacctcttcaggcaacacgtgctgagggtggcgccggcgtgcggtcttagcaacgtgtaaggccagcgcacccatccgatcaatggcagccaccatctggatggcgctcacgattgctctgaggtcaccggccaccggcgcttgtaaggccagcagtacgaaagcgctctcttcggcgcgagcgctgcgggtcgcgatcttttcgtggtcggtgatcacttgttctgcaagcatcagatcggcttgcagcaatgcttgggtggcccgctccatggcgattcctgccagcccgcacatctcgctgagccgctcagataactccgagagttgctcatggtaggcggttcgcatgtggttaagcctacgttctcgagatcgaaaacggtggcgaaaccacgtctagacgactatccgcaggtcgtgtcggctgcgttggtcaacgtcaggtcctaaggcagtttagttgacgggttgttggatttgcggtctatctgcacggtgaccgatgtgccgttgggcgaggggagtgatcacagcattaaagtctgggacgaggacaacgtgaactacgttgccaattccgttaatttgctggacttttgaaattggagaacgtcgataccacggtggttaaggcctgctcgattccgggcgagaagaagaccgtagtggccctaggtgaacccgagtagtcttcttgacgtcataacagttgaagttggcctgcttgagtttgttggctgcggtggttgccagacttggtcggttggtttacttgaacacctgcacgggtcatgcctcgcggcgaggttatcgtcatctgcttatgctgaacctctggggcggggttgttcagtatcgccttcttgggggtaggtgtagttgtcggtgtcatccccgaactttgcgtattctgattgttttcgagaggtaaggggtcatcattgatgatggcatcgaaaagcacccgcatgtcggccgtgcgtggtggttcgttgccgtttccgtctgttacgccggtaggcacggtaacaaacgtaatgtgcccggtcgccatgccctgcaatgacatgcccagctgggctaagtctttggtcttgacattgtcgacgtagctcttgctgatgaacatgttgacgaggttgttgagcttattcaggttgaataatgtatccgacaagatcgtagaactcagcagcgacgacaaggataattgctgtcgtttgatgcggcggtagtccccagtgaagtcggtagtgaccttacgggctcgcacatagttcaatactgttgcccggttgacaaccttgcgttcgcggtagtctagcaccgcgcctaattcgtagtcttgtgtcggagttttcctgcacacctcttctcgttgtagatgggtccgtatttgccggtttcagggtcccagatgtctcacggtatcgggatgatcgtcaggttgcggggagggggggaacgagatcaccaccatgcgtttgcggtttgccaggatgttcatcagcatcacggtgtccgaccgtatgctgtcgacgtcttcggtgtagtttgcgcccatgttggcgttcgcccctgcgcgtgaatccataccgccgatcaaaaattctcgttgccgtgccgcctgctggggtcggcgatattgtgcgagcccgagtcaagcgcgctgacggtgttcaggtggtttttcttcgaggctttccaccggccaagccgcgtcggtcaggaccaggattcagcactgcaaacaaccccgacagtatgcgtccggccagcaacatcggtcggcggcttaatttaggttgttgtttgcgggtcttaagggcctcgggcgctgaggttccgccatttggcgcgggcagcacctcgtgtgatgggggttggcgtatgtacgctgtcgtacggatagtgggccgttccgagatcgggaatcgctaaaacgatctccgaggattaaggtcggtatgtcgatgaactgggtaccttactcgtcgtcggggtaatcggtgacatcggctaagacatcgggtggtttgatgtccggggtttggtggtgggctatatattaggggtgactggaccgctcgggagtgtaagcgccaattttggcgattaaatcggtgacggtatattaggccgacggcatgagatccggtctttttggtgtcgacgggcgattcgtccggccatcggtaggacacatgatcgtgttcggatgcaaaatctgggctcttacagcgcggcgttaaacgttcgctgcgcgtcgggggtaattcgttgatcatcgctgtcggcaccgtatccgcgtcgatggtcaagagtggcgctattctcgctctaattcacgtcctgccggtttccgcagctctgtgcggacgtcacaccgtgcaaaatggtcaatgcaccgctggtattatcagcgctacaactgccacttaagggcatatggtactgaattatcgatcgagacgcggttttggcagagtttcgattcagccaccagattccatgatgtcggcgccgatcggcactgtgcagtcgtcagggtcagtcagccagctgtcgggcaatgccacccaggcgggtgaaccctgcctaccccggggtccgatcgcggcatccgggaacggaacagctccgtccaaccggtttaataggcagtcaagttcatcgagcgttttgaccagtgccagtgcgtttcgcaattcggatccggcgggaaagccgtgcaggtaccacgcgatgtgtttgcggatgtcgcgcatgcctttgtcttcgccgaaatgggcgactagcagtttgccgtgccgacggacgatttcggcgacttcgccgagtgtgggcggggcgggggcaggtctgccggtgaacgcggccgacagctcggcgaacagccacggacggcccaggcagccgcggccgatgaccacgccgtcgcacccagtgacggccatcatggccagcgcgtcgctcgcgtcgtagatgtccccattgccgagcacaggaatcgtccttacctgctgtttgagttgggcgatctgtgcccaatcagcggtgccggagtagcgttgagccgccgtccgggcgtgcaatgcgaccgcggctgcgccctcagcttcggcgatacggccggcatctaggtgggtgtgatgctcgtcgtcgatgccgatgcggaacttgacggtcaccggtattttggtgccttcggtagcacgcacagcggcagcgacgatctggccaaacagtcgccgtttgtatggcagcgctgccccgccgccgcgtctggtgaccttgggcatcgggcagccgaaattcatatcgatgtgatcggccaaaccttcgtcagcgaccatcttggcggccgtgtacgtggtagccgggtccacggtgtagagctgcaacgaccggggcgactcgtccggtgcgaacgtggtcatgtgtatcgtgactgcatttcgctcgactagtgcacgcgcggtcaccatttcgcagacgtacagtccgctgatggtgcctacctgcgattgttctagtggcgatcgcaagtgcggtggagctgggcgcagcaggttgccacgcgttgaaccaaattcacggcacagtgtccggaatgtgacgttcgttactccggccatcggagccaacacaaccgggctggtaagctctatcgggccgatgcgcaatggtcaactaccgcccactcatcctcagcgtgccttcggtagatagcaccttgcgtgcggtgattttctcagtccggcgggcttcgcgttcaatgtagcgctgcttggagacttcgaacttgtcgcacgcggcctcaagctctgtaagatgctcgccgatttcgtcacgcaaccgtgtaccctcgccgctgaagtcttcgcgctccaagatccgccattttttgagcaccggcatgaccacctcgtcaaggtggatccgaatgtcgtagacgccaccgacggcaattatcacggccttacgccggaactcaggaaccaggaatcccggcatcttaaagttgtgcaggatcttgtgcagtgccttgatcgcaaggttgggtgcgagctctatgccagcttcgctgacgtcccggtagaagatcatgtgcaggttttcatcgctcgatattttagcgagcagctggtcagcgatcgtctcgttgcaggccttacccgtgttgcggtgcgagacgcgggtagccagctcctggaatgtgacgtagaggatcgagtcgaacagggtgtcggcgaagagtccgccttggtgattctggcccgggctgaaaccccggttgactacctcgatgcgtagtttctctagctccaccggatcgaccgcgcgggtcaccaccagatagtcgcgcagcgcgattccgtgccggttttcctcggctgtccagcggttgacccactgcccccatgcaccgtccatgcccatggtcatcgcgatttctcggtgatacgacggcaggttgtcctcggtgaccaggttctgtaccatcgctacttgggcgacatcggagagctggctctgctcggggtcccaatcctgaccgccgagagcgtagaagttcttgccatccgaccacgggatatagtcgtgcggattccagttcttgtgtaggcgttcatgacggttcatgtacttctccacgaccggttcgagctcgtgcagcagctgtaggtcggtcagctcggctgacatggctcctccagttatctgtgtctattggttgcagtcaacatatctgtgtatctcggtagcatcaagttcccttccggcatgccacgtcgtggggttaccggccgcatcggctggccagctcatccttcgcgtaaccctcgaaaacaggactgcagggaactttgtagctccctgccgggcaaccccagtcacacgtcgtggaatgcaccgatcgctcgatttccttcagcttgtccggggtacgcatgtggcagccgtatttagcagcatccccagtgcagtagtcgatgaactattcgcgtgtggcccccggcagtccgtgcagatacgcagatactaggtggtgaacagaccggtgaggtctccggtcaagctggcggcgaccattttttgtaagacagggtcgctgctgatccaggataacttgtattgcggcaacgcgatgaagttgggcagccattccgcgccggacttagccagcacgggcttgactgttaggtgccagtaagcagcacgtgccagcgcatcaggttgtcgaccaaaagcgcgacaaattggtttgacggtcttcttgaggggtcttcgccgagacgagggttgtcatggcccgcgtgcagacgtcgtcgtaaaccacacgcacaaaatttgtcttcgtcacggtcaggaagtgttcggaggagtaccttttggtcagctcggctctggggataccgcgtggatggtcagcaccgatccgctgtagctgccgagtaattgcgtaccggcagcgatcaagttatcgcgacgtacagctaggcaactttccagtgcgacgccagactaacagccccatcgttgatgggactgcgcaccactccctagagtttcaaagcgacaacgtgtgtagtcagaatgactcaacatctacagaaacacgtcagtgactcaagattcgtcggccgcgtgcccgtttaccagcgctaaagatcacgatggtgtggttggttgctgtccggtgtcgtcactggctacaacgcgccgccactcccgcttcgctcagaatcgctgacgtggcggtatttcggcgattagcgtggcctgttgcaggggccagggcgcgatcgatgcagaatatttatcctctagctgggcgcggtggtcgaagatcatttgaccctttccgggaacactggcagcggctgctgcggtcgttttaccaaattggcgctgttgttttcgatgacgaccatacctcggtgaccgccgctaaggtgcatgatatcatcttaccgtcaaatgcgtcgacgctgttaactgtcgctaccatgcatcatacttcccgctataattttactaggtgtatgccacgttctttgttggaattttgcatttagcaggacgattgtacagcggcctgatcgaaggccagaagcgtcatctgttcgatgaacacatcgcgtggtatcagatatatatatatatatatatatatatatatatatatctggaatgaatatgcgcccggcgcagacgtcttggaggaattccgggtctactgagatcgagtgtgtcgcagcatgttggagaataatcaggaggcaagtgccgtactcgatatgatcgaactatctaaacctgctttctttcgctcaatgggttccggattggttgtgggcagcgtagcagtagattactggccctgttctttgttttggcttactgtcggtctttacgatccaccggtccgggagtcggtgggttaccggtggttgcgtagcgacgaatggttgcacaggcgctttggcagctttgtccgcttgagtcttcgcgttggtgccgcaccggttgtagaagcgtccgtgggccagcgccgactgggatcgtgcgactgggcgcgtgcccgctgacacgcatcgttggtgcaggcgtctgtgcgcaaccggttgtcccaggatgagcgggacaaccacgatgcattactgctctgaatcctgactaacctctgcggttcgggccgagtgggacaccatgccatggtggtgttcatgcgcatgcggtgcgtcgtgagtttgctgcttggtgatctcgttatccgccgccctagcgggtgggtggcgttgcggattcgtgggctggcttcaacccaccctcggcgcggtgatgacgcgtaatccctgggcgtgttcggcgttaaagacggcgtcgatgaccaactggcgtacgtgatcgtttttcagattgtagaaaattgtggtgcagtacggcgggtgcgcaccagacgtgtcatccgcagtttcgtcaggtgctgggagaccgacgatgttggcttgtccacatgttcggcgggttcgttaacggacatctcacggttcgtcagcgactacaacactggcacccgggtggtgtcggcccacattggtaacaattcgatcactaaactggcctgatcaccgggtaatcaaccgcgactacctaatactattctataatctgtatatatatatacagtatagtagtgctgtcgccaaagtgtggggaattggtcttgcgacagtaaatagaataaactatatccattcttgaacatttatttctgcatgtgtttgtggttaggtatggtagcgttttgtctcgtaccgaacgtgatcgttgagatctcgcgatgagcgtcgaggtgacggcgaccacggttgccgcttagcgagtgctggtctctgacgaaaagctcatacgctgcgctgctggttcatgctgtttgattcgacgtctacacgcgactggtcatcggccgtatttctgtgttgacgagaattccggatttaatccgcaacaaatggcccgggggatggcttaccgcaccaggttctatgataactttgttgatgtgacaaagagcggcgtcggccaggagtgattttcgtggcaggtttcaatgcgcaactatcggttaacgtcgccggcgggtaccgtggtctacgagggtcacataccgaaggtgacgaattcaagacagtgacattgagtgatctaggcgccgagccgaaccgccgagtggcgcaatggtcgcggtcgacttgcgcgatgactggactgcggcgctgaagacggcgggattcggctcgcaggctgttacggcgtggagagtaccgaagggttgctggtctacttgccggacgtggcccaggatgccctgttcgataacatcgccgctttgagtgtcccggcagttggctggcttttgcgttcgtgcccgccattgctatcgttcatgaacgagcggtagcccaattcactcatcctcggatgagtgaattgggcttcaaagtcgatctcaacgatcttgcccaccatagtcaacgccgtcacatcgtcgactatctaagccagcgcggttggcagacatcgtccacgcacggtcaaggaccttcgtgcggctaatggcttgatctatcccgaaaacgccatcgccgaggacttcgctgctataatctatagcggtactcgtccgtttatgcgataccgtcaggagcgtgcgaaagcctagtggtgcagaaggttatttttcatgtaattggtgagcaagtcctgaaatactgcacgaactggtgtgtacaaatcgtgataattgtagccagcatatccctgtcgtacttcggaataggcttgttgcgtgtccagaagctggggtcgatatccgttaggaaaaatggtctaggtttgggccctatgacccggtgcagatgggaattagaatcgaccgcctgaccgatattcctgggccgtaacggagaatgagtgatttgcctcgctgcgtttcgcgggtggcatcggtgctgtgccagagccaccatcttgcaagccacgttttgagtctgacgtttgattggcaactgatggcaaaccggtgttgcagctcctagccggatgattcggttcgggaatcagttgccgggtgacggatttccagtgtgaccagggcaacgggcctggttaaggttgactccatcgccacttattcaggaaagcataaccaacgatatggcggtaacacgtcgtttagccgcgcgccgtgccagtaagtccggcaccaccccggtagaccattggcaaacgagttgctgcacggcgctatcgtcgaaggcgccaacatcggataacgtaatgatagcagggggatcagtgcccccactaggactcgaacctaggacctgcggattaaaagtccgtagctctaccaactgagctataggggcgtggatatttaggataccggtctcgggaactgagctcgtttgaggattgggcccacggtgacctaagctgactgggctccaacggtaactgcgttgtgagtaccccggagagatgcggttctggcccccttcgtctagtggcctaggacgccgccctttcaaggcggtagcgcgggttcgaatcccgtagggggtactgctacgcggtgacgtggagcacaagcaaggccctgtggcgcagttggttagcgcgccgccctgtcacggcggaggtcgcgggttcgagtcccgtcagggtcgctagcgcagcgaggcacacacgctgccttctggccaggtagctcagtcggtatgagcgtccgcctgaaaagcggaaggtcggcggttcgatcccgcccctggctaccggttctgagctgtgcggacactgtgatggcagctatggacgtttcagtgtctccggtttctatccgttcgcctgggttgctgcggagatgtggagccaggtccggtcgaggttcgtggctacgcagccgagtttgtcggtgtatgagatcgctgtagatattggtggtgccagttggtgtggatcttctgtacgtagcgtaaggtcggcgccggacactcgggccaggctggtatgaggttgtggatggtcacaggtgcgccaagtgggttttttgaggaatttgttgcagttggtttccggcgtcagttgcttgatctgagtaaagccgccggtcgggtgaggtagaccacttgttcttgaggtgcatggttgtcgatgcgtggattgagggtatcgataacgattggcgtgcagtgggacggtgcggacggctgcgcgcgttttggcgagccaactatgatccggcttttgactgccggcgcggcttggcggacgttgagcctgctcgccgttaggtagatgtcgccgacgctcaggccgacgagttctgaccagtacaattcggtacaggtcaggatagttacgacgttgccttggtcgccacacgccgctgcgagcgtggccacttgggcgtccgtgaggtagcggtggcgttctcaggacgcatccactcggctgatacgtcctgatctgagtttatgtgaatccgaccattttagcaggctatgtcgagaatcgaccgcagcagccgaagcgtggtgaatttagctcacgggccgacagtgagggtgtcgacgaattgctatacgcccttgcggcagattttgtcggtcggttaggagtttccaatgctgggtgtaaccactccacgtcttgggcgacacggctgggtgttttgacgcgctgtatttgggtccagatttaggcgagtgtgatgcagcccagtcgggggtcgaaccgcctggtgccaagtgtcgcttcactgttccgctcggctttgaaaatttacgcttatagcaataaggcacaggcggatggcgtttagacccatctcgacgagaaggctggatcgcgcactagtgtagcgcggttggccggctgaattgatttcgctttcggatgccgcactataccgagccgaccatttagcggagcacctacttcaagtatgctcggatttcctttgtttctcaacatcttactcgatctgacagcgtgtagcagggtagtctcatgtctccgccgtgttcatggaacgctcctcatcgactcacagtcgcagccgagaagcccagcagttcgcccacctctttgttctcaacagctatggaaacagcgcaaaaagggttgccttggttgtggtgcagggaattaccatgtcgataccttcagcgctttactagacccacgtgactaggacgagtgtatctattaggtattattcttttgtagaacgagttaacgagtacggtcagtagtcagcatgtaccgttgactcgtttctgtcgataatgtatccattaccagggtcacttgggttgatgcgatgcacgggtgcgcgatcagccgtgccgccacgcagaaactatcgtggcctcctcgtgtgaatgaagccgcaaagcgtggtctgggtgaacaatccgcacatgggcaaggcatctttgcgcgagtcttgtgcgaatgcagcgatcacgatgccgaacttttcttctcttgttcaatatgcgtgaaaacaattccgttacttgctttttaaggacttcatccgtcatgtagatggtcaacctagccaatttatcgatgagcaatataacgatgggtcaaaatatttttgacatacgcgagcgtgccttacaggccattccgcagccccggacatctagcagttcatccaatttggttagaagccaggctgcttcttcctctgtcgtcgtgaccttgcttaataaggctgagccgatggacgtttgatttcgtacttgatatctatgacaagctggttcactgtccccgaattaatatatgggcttaacccgctggtaattccccagaaaattgatctttacttgcgtcaaagcacccaacagtgagagtgtgacggccagtgacaggtcgaatctgtatcgaccagttctcacgtctgctgatttcgtctgccgacgtttcactagtgcatggctatgtagcaatttccacagtcgacagttgttcccacataaaaaattccatacaaattgttccgggaacaactattgtcgattgggcggaatgcgccccgacagcatcacgagttttggaagccgctttttatgggtcatcgaccgtctggtcgatacgggtgtgggcggcaatgcgtaaatagttcttggaccttcttactcctagtagatgtttataaatacagatggtctggtcgatttctttgtcctgcatgtaattatgggtaatgcgctcttagcttaacaagccgtcatccttagcgactcgcggccacgaggtcacgctccagagaattcaccgggcccacctgacggggcgcgcagaagtggaactcgtaattatttggttaccgtagtatccaagcgaggagcacagtcgcgaccacgacgaccg

SEQ ID NO: 138 - DNA (genomic), 35961 bp, Mycobacterium leprae; double-stranded, circular
  hypothetical: NO
  anti-sense: NO
cctccattactggcgagtctacttggccagctgcgccgatggtttgccgagcttcgcggcagcagtatgcccgccacggggcggcgggcataactgtctgttacctggcttcggctggcggccctgacctgggtggcctaagtagcgtgttaactcgcgtacgagcgtagtcggtcagcgcgctcaccgttgcggagcttgcacatcacgtctcgctcgatttggcggacccgctcgcgggacaaaccgaacagcttgccgatctgatccagggtgcgtggctggccgtcgtctagaccgaaacgcagccggatcacctggtgttcacgttcgtcgagagtggccagcacactgcggatatcggtgtgcagaagttcggcgatgactgcgttctccgcggacatggcttcggcgtcttcgatgaagtcgcccagcggggcctcctcctcggagccgaccggcatgtccagactgaccgggtcgcgactgtgttccagcaggtcgttgatcttctcgattggaattcccgattcagcggcgagttcttcgtcagtagcttcccgtcctaggttttggtgcatttcccgcttgatccgggccagcttgttgacttgctcaactaagtgcaccggcagtcggatggtgcggctctggtcggccataccgcgggtgatggcctgtcggatccaccaagtagcatacgtcgaaaacttgaatccctttgtgtagtcaaacttctccatcgcgcggatcaaccccaggttgccctcctggattaggtccagcaatggcattccccgacccgtgtaccgcttggccagcgaaacaacaaggcgtaaattagcttccagcaggtggcgacgtgctgctgcgccatcgcgcgccacagctgctaatgcgcgtttgcggccctcgccgaagcgcttgcgagtttggagcagatgctccgcatagagcccagcttcgatgcgtttggccaattcgacttcatcggcggcgttgagcaacgctgtcttaccgatgccgttcagatacacacgcaccaggtccgcggcggggctttgagcatccagatcgctgtcaacccggtttgtggtggcttcggccatgacgccctcccaatcggcttgttctgtagtttgttttaacgacgggtcctccttgagagttcccgtcctgctgtcatctcacacgctttgacgtgcggaaatgtgccgacgacctgagaatgtcctgagaagtgcgggtcgaggctagccggtctgaaacccctggctagcttcggctgtctgtggccaatgacgtcggtttaggcggcggtcgtcgtagcgacttgaatgctggctgctcggtcgtcagcaatagcggggtgcgccttcggcggctgtcaaatcgtcgtggctcttctgtgcggcgaaggggtcggtcgttggcaattagtacggccatccacggtaacggcaccgaggccgccacgatcagcagtgagatcagaccgttgtgccaggcgctgtaggcgacggtggtcaacataagcgccggaatccggaaagccatcaaggtcatatatttgcgtacccgcgtgcgacgctcttcctcgtacgacggggcagcggtggtgatgagcaccggccggctattgtcatcgaacgtgtccgttgtacctcgattcggagccgtgcttaatttccccactgtacccaatacaagatcaactccggcgtgtccggcttctgtttcagcgtggggcgagtgcggaggcacaatgtcacaatgttagggaggcacaatgtcacaatgttaggtatgcagacccagacaatcgaacacacctataccgacgaacacgtcgacgacggtacgggcagcgacacgcccaaatacttccactacgtcaaaaaggacaagatcgttgagagtgcggtcatgggcagtcatgtggttgcgttgtgcggtgaagtatttcccgtgacgcgcgcggctaagcccggctctccggtatgttcggactgcaagcgggtctatgacatgctcaagaagggttgatcagttcagcggctcggccgctgcgatgttgtgttgtttgggtggtgacggtgttccgcccggggtcggtatgcagacgcgatgtcagccagttatgcagtcggtgggtatgtgttttcggtgcggggaatttctcctggatagaggcattgaattcagcgcccagcatgatcgcaaaaccgccgaagaacgcgaacagtaagaacgcgattggcgtcgtcaacgcgccataggtatagccagtaccggtgatccacttcaggtaaatccgaaggcccagcgtggtgatcacgaacaccgctgtggccagaattgcaccaaagaccagccggtgcgtaggcagcggtattggcagcgctacccggtaaaggatcatgacagcgaccagcaggctcacaatcaccgccgggtaatagcccaagtgcaacatgttggcccagctatggggaatgagtttcgtcactttgcgtgggcccaccactaccaacggcgcggtcgcaaccacgaatgccagcatcgcgatgtagaggaacagcgcgaaaagtcgctgctttaccggatggcgcaacagtgtctggtcatgcgcttttacgaccgcatcgacgaatgccgaaattgccgacgatcctgcccacagtgagatcagaaaccccagtgataccacttcgccgcgggcaccgttgttgacgtcgctgattgtgggttcgatgatctcgttgacgacgctgggggagaagaagctgtgtgccatcgagatcacgcgccgctcgatggtgggtaaagtatcctcgccgaataacggtgcgacataggccaagcttcccagcattcctagcaccagtggcggcagcgacaaagctgaccaaaaggctgcctgtgctgactctgagaagatcgagtcatcccaacttttcgacagagtcctcaggctgattcgccagatgtgctgacgggtcggtttgtatacctggccgctcatactattaccggtgactgcttgcgtagccagctacggaatgctgctcattgcggtgtcgttgtggcatgattcggcagggaataccggccatatccacagttgcctctgcccgatcaccgtcgaccgggtgtttcgtgcttgaagtgtattgttgtgctcctgctggtaatgtaggccaataggtggattccgtctgcatgaacggatcgtcgtatgccacggctcacctgactcctatcggtgttgatatgtagctggaattcgggcttgtcgattccttgcttggtcgttcatcgctgggtttaagcgcccgatggtctcatgaataaccgatacggcaggggaaagcaagtactcgtgatcgattcgccgtttcggtgtcgttacgtgagtgccctggctgttcaatgatgcgaattgacgcgcgaaggtttttgtgctgctatttttggacagcgacaccatttcgaaatcagcgtaagggcttgcagaggggcaccatattgtcgaagatttggatctgagaatattgcccagtgccattaaagagccgttgctgagtgaattaatgagtatttgctgtggttaaaaattcgctcatgtggactcgcgttcccgcgtgttctagagttagctgatttcaatcacgactgctaatgctgttagctttacctcgtgctcgttcgtgtgatgctggcagaagagcagttcgtctcctgaagagagcttggcgcacgcacgcgtgctgcgcagcagcggtctactctggtcagggctgcgttcatggctacttcattctcacgtgcttacattgccttagacggcagcggttttcaccttgttccccaaattgttgtcgggtgtgtcttttctcacgcatttcaccctccccggggcattatttgctcgcctggtttcggttcccggcgtactggtacatctctgcggtgcagaggaatggttgcgtacccgcagccgcggcgggattcacccttgacctgtgtgccgcggcgagcaagtccgcgttcatccatctatcgacgcttgagcaagtacagcttgctggctgtacatccggccgcggtgacctgattttgctgtgtatcgctcccagtgagctaggctcaccggtgcgttgggagtttggaattgccacggatcccgaatcaacgctcttcccgcatctgtacggtccgttgtcagtgtgcgatgtgatcagagttcctccaacttcccggggtccgatggcactttcccgccggtcgcgggatttcaaaaccgcacgtagtagtagtgaacttctatctccaccaacaggtcaggtgcgatcagcgcggacacttcaacgattccagcttccggacgtatttggccgaaaagttgtgtgcacttctccggccttgcgctagcgcagtatatccgttacatggatacgagtatggacaccgtcggtgagtgccgaacccatttgtttgagcgcactttttatgcggcgcaaaacttctcccatttggtcggccatatcaccggcaggtctggcgctggtaacctcggacgcagcgacgtgagggcccacttgcactgcgcgtgagtaatcgaccactagattcgaaatccgatccggatgagacgttgttgcggctgatcggcatgcgatcacagtagcctggggtgcagaacctgcgacgatcagttctcgaaaaagcttcgataacaagcaggttatacggatttgttggcagaggaagtttggaagacgcgatgctgctaggctgacttgtccgggcaggactgtgatctcggggtagtggtgtgacttgaatatcaaggcttaagccgcaacgcaagtaggtattgatgtcggtcgaagacacgtgagtacggagtcagccgtggaccacgagctgtcggtcacggctatcgacccctcatgacaaggcgaagagcggatggcaagaacgtgttctacggggtgttgctagtcaaggtagtcacgcaagacctgggaacggctggggtggcgtaacttcgacatcgtcttagactcgatctgacggatgcgttcgcgggttacgccgtagacctggccgatttcgtcgagggtgcgaggctggccgtcagtgaggccgaagcgaagccgtactacgccggcctcgcgttctgagagtgtttccaacaccgactgcaactggtcttgcagcaacgtaaacgacaccgcgtctacggccaccaccgcttcactatcttcgatgaagtcgcccagctggctgtcgccctcatcgccgatggtctgatctaatgagattggttcacgagcgtattgctggatctcgagcaccttctcaggtgtgatgtccatctcttttgcgagctcttcaggcgtgggctcgcggcccagatcctgtagtagttcccgctgaatgcggccgagcttgttgatcacctcgaccatgtggaccgggatgcggatggtgcgggcttggtccgccatggcgcgggtgatggcctggcggatccaccacgtcgcgtacgtcgagaacttgtaccccttggtgtagtcgaacttctcgactgcccggatcaggcccaggttgccttcctgtatcaggtcgaggaacgccatcccgcggccggtgtagcgcttggccagcgaaaccaccagccgcaggttggcttccaacagatggtttttcgcacgatcgccgtcgcgacagatccacatcatgtcgcggcgctgggcggtgggtagtttggtgccccgctcagacagctcggtcattagctgcgtggcgtataggccagcctcgatccgcttcgccagctcaacctcttcctcggcgttgagcagggccaccttgccgatctgtttgaggtacgcgcgaactgagtctgccgatgcggtgagctcggcatccttacgggcctgacgcaacgcctcggattcatcttcgtcccagacgaaatcgccggaggccttgtctttttcggtcggctcaacgatctcttcgtcatcatcggtggaagcttcgtcggtcttggtggctgcagtagcttcgccatcctcggtttcacctggttcgatgtcggtgactacgtcgtcgtcttcgaggtcgtcgagaccgaggtcggcggcttcgatgtcgatgtcgatgtcctcgctgggctcaacgtcgaggtccggttcggcatcgaggtcgtcggcagtggcgtcggagtcgagggtgttcagagtggcttcgggatcgttcagggtgtctttggctgccgaggctttagtcgtgtggtcctgcgcggacggtgcctttgtatcgacgcttttgaccgaggtgcgggccttcttcgcagcgtcgcttgccccggaggctttaggtggtgtcgtggatttggtggcccgagatgctgtactagtggctcgttttgtgggggcggagccatttgcggccttagtcgtcgatcgcttggcgggggtcgcgggcgtcttggtggcggtgcgcttcaccggctggccggttgccggacttgtcttggtcgctaccacatacaccccttcggtcggactcacttccggtgggtttgggcatgcataaccgaaagtgtctgctatgtcgaatgtcggcgttgatatcagcgtgagtactcgcgctatcggtcgggcgaccgccgataaccattgtaacggtggcacgcgcctggactgttccaccgggcaaaattcagtgcgtcacatctgcggtagaagccatggcagcgccgactatgccggccgtattctgcagggctgcggccaccatcggggtgcggttttcaagcagtggtatccatctatcggccttgcggctgatgccgccgccggcaatgaacaggtcaggacacatcgcgttttcgatggcgaccagcaccctcgttacctgcttggcccatgttcggtagctccatttgtacttgtctttgacggacgatgccgctcgttgttcggcctctttaccgtcgacctcgagatgcccgaactcggtgttaggaatcagtttcccgttgtggatgactgctgacccgatcccggtgccgaaggtgagtagcacaatcaagccagagttgtttttgcccgctccatagcgcccttcagcaagcccagcagcatccgcgtcgttgagaatggtgacttcctggctgttcagctcagcgctgataatgtcgcgggcattggttccaatccaggagtcgtccacgttggcagccgttcggacgacgccctgggtgacgacgccgggataggtcactcccaggggagcagtccatccgaatgcgttgacgacctcggcaatggtcttggcgactgccaatggggtagccggttgaggggtgagcagtttgatgcggtcaccaatcagttgcccgatgtcgaggtcgactatgccacccttgatgctgctgccgccgatatcgatgccgaacccgcggtgccgcgatgtcgtaccggcggtgtcgctaggcggagaggttctgggcgtatctgcggtcgcgtcggtgctcgttatagcaatctccttggcgagacttggttgttcgcttactttagcctggcgatgatgcgggctgactgtctggcatctgccggcgactgtgatgcgataggccagtgacagtacctgacaacgatcccgagcagctgcgctgcgtagccgaatcactggccactgaggccgccgcgttcgtgcgatgtcgccgagctgaggtgtttggtactgacctgggcgccgcaggcggcggcgcggtacgggcgaagagtaccccgaccgatccggtgactgtcgttgacaccgagacagaacgcttgttgcgtgatcggctcgctcaactacggcccggtgactcgatccttggggaggaggggggtgggcccgccgatctgaccgccacgcctgcagacacggtaacctgggtgcttgaccccatcgatggcacggtgaactttgtctacggcatcccggcttacgcggtgtcggtcgcagctcaggttgatggcgtgtcagtggccggcgcggttgctgaagttgttgccggtcgggtgcactcggcggcgagcggcctcggcgcgcatgtcaccgacgagtatggtgtacaggtactgagatgcagcgcagtcgatgacttgtcgatggcgctgctaggtactggctttgcctattcggtagtgcgccgcgccgcccaggcggcgctgttggcccagatgctgccggtggtacgtgatgtacgtcgcatcggttcggccgcgttagacctttgcatggttgcggcgggccagttggatgcttattacgagcatgaggtgcaggtgtgggattgcgcggctggcgcgttgatcgcggcggaagcgggggcctgtgtgcagttgcctaagcggaacgggcccgtgggcggtgccggattggtggtagctgccgcgcctggaatcgccgacgcattgttggctgccttgcagcgattcaacggcctggcgccgatcctggactaaggatcagcagctgttggcgtggatcttttgcagcagtgcaggatctgacggctcggtggcgccgggacgcaggctggccagcacagcgtcgatgtcgtcgttgtgcgccagcgcggtgaagtcggtgcccagcgcaaggtcaaccgagtcgtcggtgcggttgtcgtgcagcaactcggtacacggtgctaccagccacaccgcggctacggtggcttgcccggcagtaccgaaacggagctgaccttggcagtttagtagagtgtcggcgtacatcgggtcgttggcggcggttggctgggcgaatcctagatcccgcagtgcgccggcgatatcggcggcttgaccgtcccggccgctggcattgagcacgtggaccttggtgtcgctgagtttggcgggtgtgacgtcagtcatctccgtccgtggcacttgtttgcctagctgggtcggcaccgacccggttgattgcgtaggcgggttacacacttcgggctcacgaaccttcgctggtcgggtgagtgcaatagtccatgacacgcccgccactatgaccaagaacactaccacgaaaatggcagggcgggcattgcgtcgccgaaagggccgaccgtgcttgtcgaaagcggtaccctcggtgatttgtgtgaccacagttgcactctaaaacgcaccgttcgaacctgaaaaacgcactgttcgaacctgagcacaggggtcaaaatagtgatgttacgtaaatcacactttaatggacaggaattaagggcacgaatcgtttggtggatgcgttcgacgctggtacaaagcgttgcttgaggttatgagggcctttagaggggattggacatgcctaccgactatgacgctccacggcggaccgagactgacaacgtcccagaggactcgctggaggagctgaaagcacgacggaacgaggcggcgtcggcggtggtcgacgtggacgaatccgaatccgccgaatctttcgagctgcctggagctgacctttctggcgaagagttgtcggtccgcgttataccgaagcaggctgacgagttcacctgctcaagctgcttcctggtacaacaccgcagccggctagccagtgagaagaatggtgtcatgatctgcaccgactgcacggcctgatcagtcagcttcgtaatgccgacagtacccgctccgggtgacggcaactcaccagccagtatggcgtcgggtcgtccgggtcatcgaggactaccagaatcatcggcccgacccacgcccgatgcagcacgtaggccgccgggtccagttggcggcctagtgctgccgacttggctgagcgtgagattgcggctgactgggcgatcgcggtgatgggcagatgcgcgtttcccgcccacagttcgacgctgcctccaaggggagcgtccgcgatgacctggatctcgactcgacccaaccacaacaatgtcccggctgccacagcgaacggtagccaactgggtagggtggcaccactcaagttgacttcgaatgcgatgagcgatgctagcgcgaaggccaatggccaccaccaccatggcacccataatcgctcgcgatatcgcacgttgtgcggtgcgacgggggtaccggacacacggtcaagggtagtctgtggccccgtgtcgaccagtctggccgttgtccgtctcgatcccgggcttccgctccctagccgagcccatgacggcgatgccggggttgatctctatagcgtcgaagacgtcaaactggcacccgggcaacgtgccctggtgcggacgggtttggcagttgccatcccgttcggaatggtcggattgattcacccgcgttcgggattggctgtgcgggtggggctttccatcgtcaacagtccgggcaccgtcgacgcgggctatcgcggcgagattaaggtcgcgctgattaacctggacccagtggagcccctcgtggttcatcgcggcgaccgtatcgcccaattgcttgtgcagcgggtcgagttagtagagctggttgaggtctcgtcgttcgacgaagctgggctggccgagacatcccgtggcgatggcggtcacggttcctccggcggacatgcgagtttgtgaccgccgacgacgatgcagagcgaagcgatgaggatggagcggcggtgatggccacattcggtaaacgtacaggcaaagacggcgcgagtcgcacgttgaccgaacccgcagacccagaagccactgagctgccagctgctagcgagcccgattccgaagaggtggatgagctggagggcccgttcgacatcgacgatttcgaagatcccgcggtcgccgtgctagcccgacttgatctgggctccgtgctgattcctctgccggagggtagtcagctgcaggtcgagctgaccgatgttggggtgcctaacgcggtttgggtcgttacagccaacggtcgtttcaccatcaccgcctatgcggcccctaagacgggtggtctctggcgtgaggtggccggcgaactcgctgactcgctgcgcaacgattcggccaaagtcaccgtcaaagacggcccgtgggggcgagaagtggttggcaccaacactggcgtggtccgcttcatcggggttgacggctatcgttggatgatccgctgcgtggttaacggtccgctggagaccatcgacgtgttgagcgaggaggcccgtgcagcgttggcggatactgtcgttcgccgtggcgatacgcccctaccggtgcggacgccgttgccagtgcagctgcccgagcagatggccgagcagctgcgggaggctgctgtggcgcagcaaagcgcgcaacacgccgacgcgcgacagcaatcacgcgagctggccccacgtcgcggtgctgcgggatcggcgatgcagcagttgcacaacactacgggcggctagtctcgctccttaacgccgcttcgcggcgcgtatcgtccgtcgggttaggtgagagcgagagcagccaggcaggcagtacccagcgcggcggcgttcgtgcctatctggttgagtgtcaccgtctgcaatgcggcgtgtggcgcggcggtcacccaatcgacgccgacctgcagagggtggatcggatcatcgaccgcggcggccacccccagtggcgtggctaaccgggctagctcggcgcagctcggtgcgatgtatgccgccgcttcctccatcgcgtcgggcagcagtggccactggccgcaccacgagcgggccagttcgtcggccaaccaaggtgggcttgatgcctgcatctgtagcgtagtcgccgccaggccgtcgcgacgtagatgcgatgccgaataccgtgccgctagagcggcgggcgctgattctggtgccccgttccaggctggcagcgcggctaggacggccacggcgcgctcgggatgagcgagtgcccacgcggcggccaccgcggcaccgatcgagacaccgccgacgccgatcggacctgcgcgtgctgcgtcgtccaaggcggacagatagccgtcgatcagccgattcggctggggtggcggcgtcagcacagctgcgcccactcggtgcagggggcccgaaaatgcccgataaacgtagtcgtcatcggatccggttccaggcagcaacacggttgtcacattgcgtaaatcgacagccaccccttgatagtgcccggctgttcacgggtgctccaaatatcatcgttttcgtctttatggcggaggggaaccagcaggtctacggtggccgttagctatagatcgaagcgtcgatagttggatgagtatcgtcaggagtggccatgcgggaccgaagtcatctgcgttggctagcgaaggacctggcaatgcgattccgaggatttatctgacgagttactcactcggcaccggctcgcacgtgtgattgattgttcggtatggccaggagttcgcaatggtgggtacgctgcgcagcgtggaaaccaacggcaagatgatgtgccgatggggtccgcgccgaattgttcaacggtagcgacactatgttcaacggtagcgacactaaagagttacgctggtgcgcttggggcaacgtcggatacacccggtatcgacttggggtggacgcggctggtgctattatcggccgggcaagctcaacaacgggagcaagactacaagaaagaactataatccgcattacgaaattcaactatgacagccgccagtaattcgagagtacggccgctatgtacatcgttgctggactcttgggtatctcgtgtcggctggccgtcccggacctgaacgggtgctggcgtagttaggctaggtggcctttctcaatatatttttattcgtttttatttttatttctttgttacctttgatggaatccgtgtcttgatttgctgcccgcactcgaaagtgcgttgagtgcggctgggctggtcttgttatggtggctaattcgctgggaatcaatgcagccggcaaacaccggatttttggggttgcggtatggtcgctgatcggcctactataggggggggagtccaaggggtatttcctgttgggaatctggatgttgttgctgtggtcggtggaatttcgtggtgtcgattctgattcgccggcccactttttgcctatctcgggcttgggccagcaagcgtggtcatggctgacgcgagagcccggcgcaatatacgtattcgacatcgctatgcttggctaggtgttggtatttgctgccctgctttcgtgttccagcggtaatctctacgattccgactagactggttggctgggggaagcgcggatcggggtgggtccccgccggattgcgatagccgcgctggctttaattaataattatgctccaatcgaagccgctcagcgtgtcatatcgtcttaccggcgacgctactgacagcggctgcggccacgctcgccggcggcgagctggatatcgacgctggctatgactagttagccgccgggcggcgagctgttgggcagcagtagcttgcgcaaatcgtcctcgacctaggcaaccgcgatgaagaccaaactcgtcgctcccttccaacggctcgtcggtctccggcatgatgacccgcgatccgttcaggatggtgaccaatgcggcatcccgtggtagttgcagtttgcacaccggattccctacggcgtgtcgtcaggcagggtgatcgcgaccaggttggcttggggcccttacgggattccattagtcgaacgaggtcgtcgatggcgacggcctcctcggtgtcgtcatcgccacgccactgcgttttggttaatccctgtccaccaaacttatttttttggttggtatctcactgagagtggaggtagtgatgacgaaccttctgcacaggatcggctgtcatctggacctgatactggtaagtgtaacgttgggaacattgttgattatgttggtgagattcaccatctcactgtccttcggttcgatcagtgattggttcttgtcggccacaattccgttagccgtgatgaatcttgctgtcctgtaatacttccgtggttgtgtccaaatctgttactgcatctgctgcccatgcaagagtagatgctgctgttaggcaacgtattcgactagttgaatctggcactacgtcaggttgggtattctatactgtatcctttgctatccgtttttggattatgttcgacggcaaggtttttgttaggtaactatgtgctggcgaagtccagatgattttgatcatgacagcaatcagcattggtcacttttgggtgcaacgacattcgcttctcttaccaaaatatcttgttggtcatgactgtcttcgctccagtcatcttgtactacggacactgcggtactggccagcgctgctggtgcgccgcaacgaattttacttttttccatactacctgctgctcctgactacattcttgctattgactagtaccaattcacattggcgtgctggcggcgttgttggtgttggataaagtcgactccggaattttaattgcactgtggtttacctttgtaccgttgacaacgtttatgcctaccgggtaatcgccgtgcttgtggtgacgacggtctatgtagtcgcggcgacatcgttcagtggcctgccgagagccggcctggttcccgctctggatccgatcggactgctggccgggttgtagacggtggtgactctatcgctggccatagcactgaccagcaagaaaattcagggcttggccatggtgtgtgcccttggcaaagctcatcgccagactgcctttggcaccaaggttcatcaactccggttggaacctaaccttcgacgtccttccgctttactgggacgccaaggcgttttgggtgtcctgtgccactggtatgttatggccttatctggctgctggttttgattacaacttcgctatctcctggctgatgtttcgatcatttcgtgccaagcacacctgaataaccgagctcagctcatcacgaggtaacgcaaccataagtagatcccggcgagagcgatcgagatcacagtgaccgcaatgcctttgcgggtgaattcccagaacgagatgggagttcctgcgctcttggcgatttcaagcataacgacattggcactggcgccgacggcggtaaggttgccgccgaaatcggcgcccaacgccagcgcccaccataggatgtcggtgtggctttgatccggcatggatgctaccagctccgagacaatgggtgtcatcgtggcgacgtaaggaatgttgtctatgatactggatactagagttgagacgccgagagtcaggacgacggtgagtaattcgtgtccaccagtcaaggtggtcgttgcccgtgccagctgattgaccacatcggttttcaccaaagccccgaccataatgaacaggccggcgaaaaacagcaatgtctcccacttgacgctggacaggtaatcggaccgctccaacttggagatcacgatcagaatgccggcgcccagcatccccaccagggacggcccggtgtgcagcaccggatgggcgatgaaggctacgaataccagcaacaagacaacgccgcatttgatgagcagccagcgatcgcggattgcttcacgctcgttcagtgacatgatatcggctacccgctcgggatcgaccgcgaatgcgccgcgaaaaaggcgtggcagcaatgcactgagcactactgtcacgatgatcacgatcggtgtcaggtggattaggaagtcgttgaaagagaatcctgctcgactggcgatgatgatgttgggcgggtcgccgaccaacgtcgctgcgccgccgatgttggaggcgaagacttcggccatcagaaatggtgccgcattgattgtcaggcgctcgcacaccaacagcgtgaccggagcaatcaaaagcaccgtggtgacgttgtccagtaaggccgacccgagcgccatcactagcaccagtaggagcaggatgcgcagcggggaaccatgtgagcgtttggcggtccagattgcgacgtattcgaacacaccggtttggcgtagcacactgacgatgatcatcatgcttaacagcaaaaagatgacttcccaatcgattccggtttcatgggagtagaagacgtcttcggaattgataatgggcaaagtgaccacgatcgccgcgcccgtcagggccgccagcgtcttgttgacccgatcgctggcgattagtgcataggtgacgatgaacacggtgatcgcaatgacactcatctagcttcctgcgctgctgtcagccggtgacttgtcactgcatcggtcgggatcaatgtttcagggccgctcttagaaggcgcgatgctgtgatcacaccgagcagttgtccgcctttgaccacagcgagtagaggacttcgctgccgtgacatggtggcggccacttcgatgatggtatcgtcggcgttgactggggaaacgttgacaaggtggtccggtaaaacatcgcggactttcttgctgctcaacttttccgccgcctggtcggccgtcgactcgttgagcacgccagccagcgagggatcatcctggatataccggggcacaatgaatcgcaccacctgggatgcgggcagcactgcgtagggcttgtcagacatatcggtgaccaagagtccaggcaggccgtgctccgcaagcatacgagcagcgtccagtgcgctcgaattgatgctgattgccgggaagtcttcggcgatgtcctcggcgagcatgctatgacgatacgtctgtgtggttcgtggagtgtgggcgacatcgaggcgaactatatgatgtattccaggattgcaggacactgctgtcgaccagtattcgtgactcaccgcagactgacgctaccaaagcggtggctcggttatccgtttggtgcccccacccttgcgttacctgagtacaataacggaatgctggaacagatccgcaggcccgctgatctgcagcatctttctcagcagcagctacgggatctggctgccgagatccgtgagctcctcgttcacaaggtggcggccaccgggggacacttggggccgaacctgggtgttgtcgaactcacgctggcgttgcaccgagtgttcgactcaccgcatgatccgattatcttcgacaccggtcaccaggcgtacgtccacaaaatgttgacgggacgctgtcaggacttcgacagtctgcgtaaaaaggccgggttgtcggggtacccgtctcgcgccgagagcgaacacgactgggtggagtccagccacgccagcacggcgttatcgtacgccgacggtctggctaaggcattcgagctggccggaaaccgcaaccgacacgtagtcgcggtggttggggacggcgcgcttaccggtggtatgtgctgggaggcgcttaacaatatcgcagcaacaccgcgtccggtggtcatcgtagtcaatgacaatggtcgcagttacgcgcccacgattggcggtgtagccgatcacctcgccacgctgcggctgcagccggcctacgagcggctacttgagaaggggcgtgatgcacttcactctttgccgctgataggccagatcgcttaccgtttcatgcacagtgtcaaagccggtatcaaggattccctatcgccgcagctgctgttcaccgatctcgggctaaagtatgttggcccggttgatggtcacgatgaacatgcggtagaggtcgcgttgcgtaaggcccgcggcttcggtggcccggtgatcgtgcacgtcgtcacccgcaagggtatgggctatcccccggccgaagccgatcaagccgaacagatgcacacctgcggcgtgatggacccgacgaccgggcaacccaccaagattgctgctcctgactggacggcgatcttttccgatgccctcatcggttatgctatgaagcgacgtgacattgtggctattaccgcggctatgccgggccctaccggtctaacagcgttcggtcagtgttttccggatcggttgttcgatgtcgggatcgctgagcaacacgcgatgacgtcggcggccgggttggctatgggcaggatgcacccggtggtggcgatctattcgacatttctcaaccgggcgttcgaccagatcatgatggacgtggcgctacacaagttgcctgttaccatggtgattgaccgggctggcattaccggttcggacggccccagtcataacggcatgtgggatttgtcgatgctaggcatcgtaccggggatgcgagtggccgcgcctcgagacgccattcggttgcgcgaagaactcggtgaggcgcttgacgtcgacgacggtccgacggcgatacgattccccaaaggagatgtgtgtgaagatattccggctttgaagcgccgatcgggcgtggacgtactcgcggtgccggctacggggttggcccaggacgtgctgctggtgggggtcggcgtttttgcgtcgatggcgttggcggtggccaagcggctgcacaaccagggaatcggcgtaacagtgattgacccacgttgggtgttgccggtgtgcgacggtgttctcgaactggcgcatacccacaaactgatcgtcacgctggaggacaacggggtcaatggcggtgtaggcgcagccgtatctaccgcgctgcgtcaagtggagattgacacaccttgccgcgatgttggattgccgcaggagttctacgatcatgcttcgcggagtgaggtgttggccgatttggggctgaccgaccaagacgtcgcccgtcggatcaccggctgggttgttgcattcggccattgcggttccggtgacgatgcaggtcagtacggtccgcggagcagccaaaccatgtagcttgggcctggcgacgatccggatcgtcagattcattttcgtatcaaaactattgacgtaagaatacactatttcccactggatccgcgcaatgtgggctttccttcagtgcggaattatcgttacggtctttcgcagaagaccgtgctcctgttaggttgctggaataccggtacgagtgctaattcccgatgaccttgaaagcgcgagattagcgatgtgtgcaggaccgtgctatccgctgataatttggcgccagaccaatgttgagtgcgacctgaacattagttcctgggggagataggtgaaggtttctgagtcggatttatttgtcgctggatttaccactcgtctttccgtatggcgacatgcactgtgtcacctgaaagagagagcacatgaaaaccgtcaaagtcagccaaaactcacgttgttattgccggggatgggatctctgttatgactgtggctatgattcttacctgagtcggcgtgcggatcacgttatgctaagcagcacctgaagccagaggtaaggtcgagaatctgcgccgccaagacgataacccgatcgagcacagtttgcaaatgtattggttctattaccaaaccctgctaaagttactctcaactcataaccacggataacggcatgaccgtgctcgccaatctggttggcgtgagtgtagccgtgtttttttacgggcacctcatcattgatcggcattcacgcggaaggtgcgtaaggtattcgaaccacttcaaccactggggctggatcgcattgcgcagaacagtgctcattgtcggtctggactaccaaggagtggtgtcccctacgggtcatcccaattttgatgctcaatatgtacctgttgtggatgtgctgcgagtgactcgttgcggagctgagcaccatttcatatgcagactatatgcaactgaatcgctagtcccccaggtgaagaagttttttccgagttgccgaacattttctttgcggcgtgtccggacgcaccagcagcgattgcaggccgggttcttaatgagctgtttaattttacgagtcgaccaacgtacctaaactaggtaacgccgccttccagttatgattatttatggggaccgacgaacgcataatcgagccttgtattcatcactaatactcatgtcaaaataaattttgacatgagtattagtgatgtcgagttcgagaatggtcggataaccggattgctatcggcctatggctgcatttttagttgcgactatgccattatctccttgctttatctgacattgctctaaatggtcacatcagatcacgtaaagcaaaatttactcacctaacgcactggcatacaattgcaatagattcatcgagcgggatccagtttttctacgtgagatcctggcaacatggtagtcatttattcgtcccggagtctttactgtgtgtttggacagtgagtagttccacggtctctgtggttcggggcgcgggcttctggagaaatgttcgcttgccgtagggaagtaaagtactttttatcgatagcctggagtgattgtataggtctggttggggtatttatcgaccggtaagcgaatgcacactagatgagatcttgactgagtgcttggcgcagtgcgacttcgatgatcggtcgcagattcgggctgaaagaacgattacaagctgatgcaggttaagcgaggtcgactacaaaacgttggtgggcgatctaccgccgcgtcttgccttggctcctgcgtgtggtatgcgcatggtcaatctattcgccataccgatgccgggtgctcaccatcgatcgcgtcgtattcgcacagaagtgcctaacctcatatttttgccgataaagtgggcctattcaccggagctgattttgtttgttctcaccatgcagacggcggcatgctccggctatttggccgccagccaggcgttcaacgttgcagctctgcacgctgtgtctgacttgcaatggacttgcgagatcctgtcccatttgttgtgctgcggctgtgaggatcgatgtggtggtggaaacgccaccgtacgacgctcacacatgagcgttagccagccgacgacttcaccgccgaggccagaatggtcaccacgagttctcgctgccacgctcgcgcttggccgacacgcaaatattcctcgactgcattgaccgggtcgaccgagctttccggcagaacctcccagtcccagcacagtcgtcgcaccagttcaggcgagacgagattttccgtcggtaccccaacccgctgcgacaccgtcgccagtgccgctctggccgcctccagccgtgcagcggcatctggtttgcgccgggcccaccgcccgggcggtggtggcacgttggacggctcggcttcgtccggtaggtcttggctctgtcgtgccgtttccagcgctgccaaccacatcgcagcgctgcgacgctgattggccccgccgaaaaccggcattgcgatcagctcgtcgatcgtcttggggtcggctatggctgcgtcgatgatggcggtatcaggcaggatgcgacgtggtgcgatatcgcgacgttgggcaatgtggtcgcgcgttgcccacaattcgcgaacggcggccagggctcgccggtcgcgcacccgacggatgcctgacgtgcgtcgccagcggtcccgacgggtgggtgggatagtctcggtggtggcccccctagttgcataggtccgcaggtagttgaattcctgcgttgcccaatcagttttgtcttgctcggccagcaccttcgagattgccgtgcgcagttcgatcagcagctccacgtctagagccgcatagttgagccagtccgaaggcagcgggcgtttcgaccaatcggcagcaccgtggcctttggccaactcgaaacccagcagccgctgaaccattgttgcgaggttcaccctgtcaaatccggccaggcgtccggcaagttcggtgtcatacaacgctggcggccgcatgccgacttcggccagacacggcagatcctgatcagccgaatgcaggatccattcgtctttgctgatcacctcggcgacgggtcgcagcgcggtcagcggatcattgccgtggctgaccgggtcgatgaggacggtgccggcgttcgctcgtcggatctgaatcaggtaagccctgttggaatagcgaaaacccgacgcccgctcggtgtctaccgcaaacgggccgtacccttggtccaggcgttctgcggccgccgcgatctcgctcggggttacggataggttcggtatcccgccggccgggtagtgcagcggggtggggtcgggttcggtgccgcccggctgatcgtccgccggttcgcgcatatcaggagcgtgagcgcgagcccaggtcgataactccggccggcggcagtcctgcggcgtgttccagcacctcgcagaatgctttgacgtggacgccgacctcgggggtggttgccgtccacgaggcccgtagctctagctgatgggcgcgtggtggtccggagatgtcgccgtaacgtactgacgtggtggcggtgacggtgccgcccagcgcggtgacatgatctatgcgtgattccagtgcctcaatcagccagctccacgccacttcaggcagtagcgggtcaatggcttcacgcgagtccaggtcagactggatataggcgaccaaccggatggtgccgtcccaagcgtcggaaccgtcgggatcatataagagaatcagtcggccgaacgcgttgtcctcagattgctcggggacgatgtcgagttcgggatgcttgacctgagctcccagtgcgtagctgtatggcgcgagccgctgcggcggtcgaatgggaccgagttcaatttccggccgtacagtaaaagcgttcattgccgcgactgcctcgcggaagggagtcggttcggctgcggtcacgggcgccactcctcctcatcgcttagctccgcatcgtagccggcgcggatcacgaaggtcgacggtagccccatctgcccacacgccgtgacaggcgcgccgtgtcgtggtgttcgagctggtgtcagcctctccgggcactaccgaaatgcctccaggggtatttggtgttggcaacaaatagcgttaggagctttcgccggtgcaccacgagcccttcggcgacgttggagccgctgaacctgatgcgttctaggtcgagcaatgtttcgaaggccggatcgaatatgcggtaccagtaattcaggctgtatttggtccacgcggatcgtgttttgctcctccctgcgtacggttctcggcgagatggacgggtggtcgggagtatctcagttatcgtcgacgcaggttgagaccaggccgatacgttcggcttcctcctcgaagagtgactcactggtgagcaggtagtattgatattttaatctcagctatgccgaccagcagcggacagcaaattgcagcatggtcacgggccgccacccgagttcggtgtgcccatcgatgattttcgcggtttagtctgccacctgagatgttggcaagcagcgcaatcaccagacctgcacccacggctgggcctcgaatcggccgacaccaccggctggacgaagttggccagattgagcaccagatcacggtcttcgcgcaaaatgcgaacctggccttcgtagtcgtcgatggtttctgcggtcaggtctaagctactgcccgaagaaaacgctgtgccttcactgcggaccaggacgatgccgcacggcggggttgtgattgatcaccggccagatttcggtgaggtttcggtgcatttgcggtcccacagaattcagctcagacgcgttaagaatcaggttcaacacgctttcttggccaggattgtcgctgagtgtgcagcgaaggaatagaaaactcgtcgtaattgcctggtttcgacatttctgggcgctcctgcatggtcattgatgttacgcagcgacgtcggatatgcgagaccgatcgttaggggctcgaccggtcccgtggcagtattgagatcgatgagtacccgtcgcgagcttctcgaatcgccgtatctggccgcggtcagtggacgcaaaccctgccgggttccggtgtggtttatgcggcaagccggccgctcgttgcctgaataccgggcgctgcgcgagcgatacagcatgttggcggcgtgcttcgagcccgaagtggcctgtgaaatcactctgcagccgttacgtcgttacgacgttgatgccgcgatcttgttctcagacatcgtggtgccgctgtgcgcggcaggaatcgatctggatattgtgccagatgtcggtccagtgatcggggacccggtccggactgccaccgatatccacgctatgaaaccccttgaaccacaagcgattcagcctatttttcaggctatttcgttgctggtcgcagcactgggtgatgttccgctgatcggtttcgccggtgcgccgtttacgctggcgtcctacctggtcgaaggcggtcctagtcgtaatcatccccgcactaaggccatgatgctggccgaacctgcgagctggcatacgctgatggataagctgaccgatctgactcttggatttttgcttggtcaaatcgacgccggagttgatgccatccaggtattcgactcgtgggcgggaacgctgtccctgtccgattaccgccagtacgtgttgccacatagcgcccggatttttgccacggtggccgaacacggggtgccgatgacgcacttcggggttggcaccgccgacctgctgggtgcgatgtcagcggctgtgcggtcaggcgaaaagcctgggcaccaggccgtcgtcggcgtggattggcgaacctcgttgaccgatgctgctgcccgagtggaaccctgtaccgcgctgcagggcaacctcgacccggtggtgctgttagcgggctggccggctgtcgaacgtgtcgcacggactgtcgtcgacgacgggcgccgtgccgtcgtggccggcgcggctggccacgttttcaatctcggccatggagtgttgccggagaccgatcccggcgtgctgagcgaattagtatcgttcatccactcgctatgacatcccgctcgtattgtgttgtgggtggcggaatctcgggacttacggcggcatatcggttaagggtggctacgggtgacgatgttgctatcactttgttcgatcctggtgaccgactcggcggggtgttgcgcaccgagtgcgtaggcggacagccgatggacttgggcgccgaggcattcttgctgcgccgtcccgaggtgccggcgttgctggccgagttgggtttgtcagagcgccaacgcgccaccaccgatgcccgaccattgatctacagccagcaacggctgcattcgttgccaccggacaccgtcgccggcattccgtcctcggcgacgtcggtggccggcttggtcgacgacgccacagttgcgcgtatcggcgccgaagctgtccgtccgctgagctgggaacccggcagcgatcccgcgatggccgaattagtggccgaccggttcggcgagcaggccgtggcccggttggtggacccgctgttgggcggcgtctatgctggctcggcagcgacgatcgggctgcgcgcgggcgccccgagtgtggcggctgccctcgactgcggggccaccagtttgatggaggcggttcgacaggggttgccgccggtagcggccgggccggtttttggagcgctagacggcggctaccaggtgctgatcgacgagctcgtccgccgcagccgactgcagtgggtagctgccaccgtggtagggctcgatcgtgggacttgcggttggacgctagtggacgacaccggtgcttgctggtccgccgacggggttatcctggccgttcccgccccacggctcgtgcgcctgttgcagcagatcgccccccgaacagtcgccgccgcaagccggatcgtgagtgcctcgtcggcggtggtggcactgtcggtgccccgggacaccacattcccgcagaattccggtgtgttggtggctagcggcgagcggctgcgagctaaagcggtcacgttgtcctcacgaaagtgggggcttcaaggggacacacagttggtgcggctttcgttcgggaagtttggtgatcaggtggcctcgactgcctcggacgatgagctgctggcttgggcggtgtccgacctggccgcggtattcgatgtgaccgtcgaccccgtcgatgtatgcgtgcagcggtggatcgacgcaatgccgcagtatggccccggtcacgccgatctggtcgccgaggtgcgcgccggcttgccgccgacgctggtcgtggctggcagccatatggacggtattggtgtgcctgcgtgtatcagcgctgccgggcgcgcgatcgaggccctccaagcggaagtggcacgataagtttcatggccaaacttgactacaataccctgaactcgacgattcgttacctgatgttctcggtgttctcggtgcggcctggtgttctcggtgctcagcgcgacacagtgattcacgacgtccgcacctttttcaagcaccaggagaaacgcggtgtagtggtgcgcggcctctacgatatcgccggacttcgggcggatgccgatttcatgatctggacgcacgccgaacgtgtcgaggcgctgcaagcgacttatgccgatttccggcgcactaccaagctcgggcgggcttgttcgccggtatggagcagtgtggcactgcatcgaccggccgagttcaataagagccatatcccagcgtttctggccggtgaggagcccggcgcctatatttgcgtgtatccgtttgtacggtcctacgactggtacttactacccgaccaggaacgccggcatatgcttgctgagcacggtatggccgcttgtggctacaaagacgttcgcgctaacacggtgccggcgtttgcgctcggcgactacgaatggctcctggcttttgaggctcctggattggaccgcatcgtagacctgatgcgtgaattgcgtgctaccgaagcacggcggcatacgcgcgcagagacaccgttcttcaccgggccccgcgtaccggtcgaacaactcgtgaattcgcttccatgaagacccagttcgactcgagggacccacccgtttcggggagatgtagcgcgacgcccggttgttgcacggcctacccaccgccacgccgcgggatgtcggctgtccgcaactgctagtccagcagcgggtctcggtggggggcgatcaaaggtgaggtgctcgacccaagcactggcgcctatcgctatgtgatttactacgccgctaggggtactcaagtcaccggccgtcgaccggtcggcaagtgccatcgactgcgccctggacaaggcgcgcaaagccggagtgtcggtggatttccgggtggctgacgtgacgaagctggacggattggatgaccagtttgacactgtcgtcgactgagccttttaccacaccttcagcacagaggctgaattgcaaaagttctacgtacaagcgctacggcttggcaaccaagccgagcctaaccctgtaacaggctcgagtgcgagcacgcacgatgtcaacagctttgcatgccgtggtcgttgtccgaggatgatttccgccaggtgctttccgttaatggttgggagatcacttacctgggaacgatgatcggccaggttgacctcggtgtcgagaccttcgggatgatggccactcgaaacccggatatggccgagcgggtgcggttcgtactggaccggttccgagtcatggaaaccatggctgaccgtcggtaggttgcatgcgtcgttctgggaacgagaatgccaccggcgtgtactggaagccattagccattagagtttagcgtttgggtcgtgagatttaaaccgtagcggtgattactggcgtggtgggtgcaaccgtttaagtgtagcggcagctccgacgcatgaatgtgttgcgctacgtcctcgggcttaccctcaatgatcatacggatgatgatcacagccgagtttttcgagcttgcgccgctggtcctgatcgctgatgtactgaccggcgagttggtgcgatggtgatagccgtcatacttgacaaccaccttgtacttctacaagaccatgtcgacaacgacaatcagtcgccagtttggctgcacaggtatttgcgtggtgggaatgggcagataggcgtcgatcagcagtaagcgcagctacatctccttgggcgacgcggcgcccggatcggtcagtggcaccgtcgcgtgtaacctacgcaggcgctcgcgcacccgggtatcgcttggctagcagcacgtcctagctcgaatacggcgttgcctgcatcagtgtgtcgagccgcgtaaccgccttgccggtgggcaattgtacggctaagtcaaacgccgtttttgcgcaagtggtcaccagcagaccgacgatacgggtaatctcgtccgacttgactcgctgattacgggtgatcacgccgatcgggggatgtggttacgccagatcaattcgatggactcatcgtcgtcattacaatccgaaccgtgcagcgccgccgcggcaagaccggccaggacgtcgcgtcgaccagaaccacaaccacgccccaaccgaacacgttcgcagcgatgacgaggtgcaatcctgcagataaatatcggggtagatcgcacgtaacccggttacataactgatacgtgcctagtctacccggccacacggcctaacggcccacaaaacgttgtccacaaaggaaatgaagtcacgacggatctgcaagattgttgaattgtactttgtgtgcatgttctgttgtgggggtggagtaaagggtggcggtgtgttgcagtgttgtgagttgatgtgatcgatcgttaaccgttcgtttgggttgggtgggggtggggatcgtgcgtgagatcaccagcaagggtggggcccgcgtgtttgcgggttgctttgggggttgcactgattcgacaccaactatgctggctaagacgctcaatcgggttactgagcttgtattgcttagctatgcagtgagcagtgggcccagtggctttaaaggccggcaaggtgagcgttgtgggcagctgcgtacggagatagacatgtgtgctggccaagaagtacagtcccgaacaaattgtgggggtgttggcccaaaacctatcccgaccggcccgaaagatgcaggtgtcctataaaacacttcaacatcgagtccaagctcaaccaacatgtgcgcactgggtggatgttccgcacgctgagggcacagcacgctaaaaccgggcaccaccattattctctaggtatggccaccaccagtgcacgtcccgcgaaaactacacgaccgtgtggtgctctaacctcatagcattgggcggatgatgtaatcatcggcaaaaattagacccccaaatcggcgccctggccgaacacaagtagcggattcgtgcagctgctacacctatccaaggaccacagcactgatgtgatcactgcggccatgatcaaccacaagacaacgccctaccacagaatcgctgtacaaccccagcgtgagaccaagacctcgaaacgactctcatacccgcatcaccacggcatcgataccgacctttgcgacctgacgcaccgacccgccaatacactgacccaccaccctttactccacccccacaacgagtccgcgctaacattaacctcaacacaaccgccagtagtcaccacccagcgagcccggtaatcgagcaagtagccgacaccgatgcggccaaggtgtgcgtgcggctgcccgataatcggacgcctggacgttgcagtgcagtagctagcaggggcgctattggtgtcgatgttatgtgcgggtggtgggcacaacgaggagttcgagcccgttgcaagtgagtgatttttagtgctaaagctacttgcactccgtctcggggttgttcggcagccttgccggctgcgtctcttccgtgctgcttggccactcacagcatcaggcccggtcttaccggtcggctccacgcttgactacggtccaaactgagcggacagagctagctgtttcctcgtagcgtgcgatgttcacgggggtgttgttatcgcgttggtgcgtgacttaaccgccgtcgcattgccatttttcgttccagttgatgtcctgcacatgcccgcagccatggcaggttttcgacgacgggaaccttcggccggtgattatcagtgctgacctgtaaccagcacgtcttatagacgagaggccgtagcggtgtgcctaaggctgcttccgataggcctcgtctacgtgcgcgggcgtcctggcaatcccttctaccgtggcattcttgccgcatctaggctttcgacaacgaatccggacgcgactgggggaccgcagctcattgagtggcggtgaattcggcacttgctcgagtattgtgccgtcctagttggttaccgtggctaggtgccgtcccgatatcatatcaatgtcaacccgttaacctgagtgcgccatcttcagttgctgcaggcgctgcgcgaggacctgcacactcgcgtccaccctgatgccattacggcgcaccgtgatcgccagcacctgagcccggtctttcgtagtgaaccgtttaactcggtgcgtgttctagtgcgtacggacggttctgatgactggaagtgcgaggtggcggtgcccaggtttgacgcgcatcgcttaagtcgtgactgatacgcggtcatggttacgtccctgtcttcttgaaccgggggaagcccgatcattttgctgtcacgtttgccggatcggaagttttgccagtttcagtacgcgtcgaccgtgccgtcgatgctgtccggtgtagatctcttcggaacactcgctccaccatgccgtgccggtatcgatgttgacgtgcacctcgttcttgaaggtgttgcaacgcttccgcagtatccgaagtgtcgatgtcgcggtctctaccgtggtggcgccacgcctcgatgtcgacttttagggccgtgacggtccaggtgtatgccttacaccggtcaccgaaatgtcttgccagcataagcgattgatcgtcggtcgggtccagggtgaatcgccaagcttgcagcaccgtccagtcctcaggaatctcgaactctgccatcatgttaccttgcgttctccggcgtcagccgccgcagcgatggcccgcttagcgtggttctggacagttcgattgtcatacaaccgaacacacatactggttcagtatctcggtcatgtcctgcgcccgatcgtcgtcaacttcggactaatccaccacaacaagactagtggtcctgcgttgccagcgctgcttggacgtagtccgatctgaaccggcagaaccggtcccgatgctccacacgatccagcccaccgtcggatcatgcagcagcgcaagaaacttgcgccggtgactgttcagcgtggatcagaactcggtaacgaccttatcgaccgggctctgccggaccgtggtctacgcggtcacctgggcgacctgccgacccagatcagctttatgatccgctgaagacacccgcgcatacacccagcgaccacacacgccacctttgccagtcggctcatcgacaagaattagcaggcccactcgctgcgctggtaccggcaacagcctggctcgaagccaacaatacgcagttccgcgcaacaccgctgtgcatcaagcccgcgctgcgagattcatacccctgttcctacaacacaccactgacaactaacggctactcagaccgcaacagctgacaactccgtggtctcggttggccgttgtggattgggtcccttaccgggcctgacagcaccgcacaggccgcgtcgacacgggttagcataaaagttaaagccgtgtgtcactaaactggtcatcaatgagcctgtgcaacatgccgcacgggccatgcagtcccacacactccacagtatcattttagtacagtagtctgtcacatgcaaagctttcggcatggtccttgctacagttcgcctcatacttgagggaaacatcgccgtcggcgactatcgccaggtaggctttgccgagttcggtgttccacaggggcgtggtcttctagttgcacgacattccggatgcttgtcggcagatttccagccgaggcacggggtttacgcggaaggtcacaatatccgtctgatcgatgttaaccggcttgggattggcgcgtcgacacgcgtatcaatacccagccagcgatagttgcgttcgtcgacgaccggcccaaacgggatcagtgccgatgtggtttgcttgtcgcgccgctgctgaaaatggaaggtagttcgctgcgggtgtgcgctagtttgctggtccgggcggctcggtcggtaactttcccacgctcgactcgtatgttctgctctagctgcaagcagattggcatatgctggctcgtcctgagttcaaggtgatgtttctctacaatttgctgaccgggagctacaagcggttagtcatgtcgttcgtttacgtcatcgcgtttgcccgccattgagattcgggttgaattaggtgaaagttctgttccgctggtggaacggtgaccacgaccacgtcattccgttttcccatggggagcacgtcgtttctcggttgtccgatgccaagcaagtttcacttgccgggagaaagtcagcttgcttggcttggccgaggcgaggaaattctgtgcaccttgatggcgatttaggaccgctattagcgagcgtgactcggtcttgcaactaccccgggtaaccttgctcacgtgttgttggcatcactgaatccgtccgtcgttaccgccaccgatatcgctgacgcggtatgtgttgacggcgtcgtgctgagccgcagcggcttggttggtgccgcaacgtcggtggctgagcgtgtcggaggtgcacgcctggtagcggtgctggccacgccgacggcatcgactgtgctagcgattactggttgcctgattgccggtgtgccggtggtcccggtgcccgcggatatcggtgtggtcgaacgccggcatatgctcaccgattctggggcgcaggcctggctgggtccggggcccagtgcggactcggcgccggacgggttgccgcatatcccggttcaactagatgctcgctcctggaaccgctatcctgagccgtcacctgatgccaccgcgatggtgatctacacctcgggtactactgggccccctaagggggtactgttgagccggcgagcgatcgccgttgatttggacgcgcttgcccaggcctggcagtggacggccgatgacgttttggtacatggattgccgctgtttcacgtgcacggccttgtactcggtttgcttggatcgcttcggattggaaatcgctttgtacacaccggaaaacccactccgaccgcctatgctcaggcttgctctgaagccgggggatctctgtatttcggcgttcccacggtatggtcgcggctggtggcagacgaggcagttgcccgggcgttaagacccgcgcggctactagtgtctgggagtgcctcattgccggttccggtatttgatcggctagcgcacctcacaggtcatcggcccatcgaacggtatggcagcacggaatcactgatcaccctgtcgacgttggcggacggtgagcgccgtgcgggctgggtgggattgccgctggcgggcgtgcagaccaggctggtcgatgagtccggaggtccagtgccctacgacggggaaaccgttgggaggcttcaggttcgtagtccgacgatgttcggcggctatctaaatcgaccggaagcgacagccgaggcgttcgacgaggacggttggtaccgtacaggtgatgttgcggtcgtggacagtggcgggatgcatcgcatcgtgggtcgcgagtcggttgacctaatcaaattgggcggataccggatcggcgcaggagaaatcgagatggcgctgctaggacatccggatgtgcgggaggtggcagttgtcgggctgcctgacgaggatttgggtcaacggatcgttgcattcgtcgtaggcgcagaggcattagatgccgatgagttgattaactatgttgcccaacagctttcgatacataagcggccgcgtgaagtccgcttcgtggacgcgctgccgcgcaacgcgatgggaaaggtcctcaaaaagcagttgctcttcgagggctgactggcgctacgacgagtagtgattatgcgggcacgccatcgttgcgaccggcacgggggccggatgtgttggtttggtcgccgcgccactgtagagcttcaagagccacggcaatgtggacgctagtgtggtcgaggggtcgcggtaggagtttttcagcggactcaatcctgcgtagcaaggtgttgcggtgagtaaacaaacgtttcgccgcacgggaggcgttgcactgttcattgatgaatgtcaataacgtttgctgcaatgccggactggctgattcgaaatctccgagcgtactggtgataaattcttttgcatcttctggattttgggtgatcaacgagaccagttgcacatcagcaaagaacgcgacctgttggtgagatttcagccgggctaaggtgcgttgtgcggtgagagcttccaagtggctgcgccggaaaccttcgattccagctgagctagtcccgatggcaacacgcgccttagataggttgagcagcgccttttgtacctcagggacatctagggcgagtgcgtcggccaaccatacccagcgggtggcggcgcttgctaccacgatcaattgctgggttgactcgacgacgtggctaaatgcttcagcggcctggtcgaggtagccatggtcgccatcaaggtcgtcgctccagatcacggcggcggtatgtgttaggccgagacgatagcccaagcgcgcttcggcacgctcctgggtgactggtgcgccctcgagaatcagatcgacaacttccagtcgttcggcgtgtgtgctgcgggtcagttcgtcgcgttccagttgcatgtgcgtggcgatggcctctagcgtggccgctacgtactcgttgatcgattgcgcggatacgttaagtatttcgcgcagttcttgggggtcggaggtgagtgtgaacgcgatctccatccaccgtcgccaggctgtgtactgcccgactctataaatgtcgagcgcaagaacgtcacgcccgcgccgcaccagatcccgcgccatggttaggggctcagggccgagatgagccggtaccggggcgccagggtcacgtaaattggcggtagcccagtgcaccagatgggcacggctggcgcgccgaacgaccttggccaggaccgggtcattggcgatggcggggttggctgcgaaggtagcgcgatcaagttggtcgatccactcctgggtagggttgagcgcaatccgtgccccttcacggatcagttcacgcactcgtggcgacgggtgttgcctagccatgggctcactgtagggccgatgtatgcagattgacaccttgggtcgagccaaatgggaacatttcacccctgagccgtcgcagcgtaactgtcgtgtccggcgtaaattctttgtgccatcaatggcgtcgatgtcgacggtggatagcgggagcaagtggtccggaacaccagcaattgtgttgagtttaagccaagtaccactaggtgaacacgggctagacggatggctaattctgggttctgtctgcggagtgtgagtccgactgattgccggtctagtgtgcattctgcaccttcgtatgggcaaaattgg

SEQ ID NO: 139 - DNA (genomic), 36800 bp, Mycobacterium leprae; double-stranded, circular
  hypothetical: NO
  anti-sense: NO
cccgaatgctggttgcgggaacattcggtgtgctagctttgatgctaggcaattttgtgctggcgatgtttggtttgggtggcggaacaggtctaggtttgcgcagcggcggaccggtggctatcctcttctcactggcgtgtatcggcatcgcggcatttggctttcttcttgacttcgatgcggctgaccagatgatccgcgcgggggcgcccggagaaggcggcgtggggtattgctctgggcttgaccgtaacgttggtctggctatatgtcgagatcctgcgtctgcttagttatctacagaacgactagctcacctcacctattaagacacaagagccggcacgccacctggtatgtcagctcttgtgtcttgtgttgcgttaccccgcgggctgctctaactgagcaagctcgattaccatcgccatgccctgctcgacgtcgacgcacatgattttctagaccaaaatgccttgttgtagttggtcaagttgctcagcagcgtggtaacgatacgtcgcaccggtcatgccaacgggtgacctagcgctatcgctccgcccaacacgttcagcttgacttcgtcgattccctgctagcgtagctaggctcaggatattcagtgcgaaggctttggttgatctcgtccagatcgatgtcgcttgctgacatgccgactcgttgcagcaagcagaatgattttttgccgtgtgtgtcactgtccccaaacacctgcggcgcacccgacctctagggtggcacggtagctgatcgccgcagcgtgcgatcccggtgccaacagttgatacgcttttatccatttctggtgccagccttgccggcttgctgcaaagggacaataaagatgatggtgtgttgacccattccaaggctacactaaaatccatcgccaactgaacgtagtcgggacgcacaagtcgatgaacgtgtttggccctcaccagccgcgtgagaaaactatcctggtggttcacagcgccgacgagcagtagaggttgatcatggggttaagtagtagaattcttataggtggagttcgacggccaccacgcgggcacgcgggctatgtcaccgaacttaccgcctggcaggccacatctaagattccaagatgaggtcgtcgatctcgtgcgacttcagcggtcggcactgtgttgagggtggcgtgaacagccacgtcgtcggtttgcatactaaccggcgacccccttcatagcgcggctgatcggtgaatgggccgttgcaacgataacagcttccagtgccggcgtaggcgaatcctctattattatgtggtagggatcatagacaggtggggtcgactaccggcgacgagcaataagaagacgtagttcagtctagtcgttgtcctctagtccggacgggcccgggctgcaagggtgccggccgcggcgccgcggcagtgacatgacgtttagctgcgtgtgtttacgggggagggggctgatttttcgtgcagtacccgcaccagctggtcgatctccgcgcatatgtcgtcgccgaggggggtataaccgtcgacggagcgcatcttctcgggcgtggcctctatgattggggcgccgacagatgcgccaccggttacccggcacaccgcaggctgttcggacatccgcagcccgcgagtgctttccagccagcgcagtaactgcggaatggcggagatggcccccagatcccagcaggtcccaacgaccaccatcgcgatcgcgctccgggcatgcaatctgtgcactgtcaagcccagctaaccctggcacagactagcatcactgctgcgtctggtggcagtctagttattaacatcacatcgatttggccgcccacgtcttttaaggtggtgccgacaatggttttggtgctcagccggatgtgcttaccagtttgctctgctaatccgcatgcgatgagcacgcccggggcacctcatcggcgctgccacagccgtacacggttgccgtgaagtgatcaaaatcaatcaaatacagagttgggcatgcacgccgcgccaacatcgctgcatgggctcgctactgggttgcatggcgggatattctaggttttggggatgacggtgcgcgcgtgtgtggcttggctagccaacagattacgtgcggccagacaggccgttcctgccacaggctagtgcacccaccgaggccaaaacgatcatcggccgccgcgcggcgctctatacggccacgccactaaaactaaagtgtaagaaggccatgatgacgtttgtatgagcggctgaaaataatacgatgtacattgcggatcaattacggtatcgaatcagactcttccaaacttttgctcagaaacagctggtaagctaagtacgagaggttggttgaacgccccggtgagtggtttgaaccagatgcttaggtcgtctcgtcacataactacaactgtctagtgaagtgtcgacatgaccgcacgcagcaaggtatctggctcacctcgcgatgcttccgccagtatgaggtattccagacacgtacagttgaggcccgcagactcgcgatcagcgacggttcctccttcggcctcaacgtcactgcgcgagttgccgcgttggtgtcgctactgacggatccggccagttttggctggtcggcttagctactatttctagcgtgccgtggccgtggggcctcatcgatgtgacgtaccgtgttccactccctaggtttgtgaccattcgggcgcaggtgagtcttacccaatgtcagctcagttggtgcgagcgcctggagttatagccgtggacggcacacggcgggttattgtctacttgcatcgcggtgcgttcttagccgatggagcaaaatcggatggcaagctcgtccagacgctgtcaaactttgctgactcggcgtttcttgtggtcaactatcggctattacctaagcactcgatcggtatggccctcgaggactgttacgacatttaccggtggttgtggttgcgcggatacaacccgggacgattgtgtttggctggggattccactggtggatatcttgcgctcgtctgcgtgcagcggttgcaggaggaaggcgaagagccagcagcgcttgtggtcatctcgccatttttgcagctagcaaaagaatgcaagcaggcgcaccccaacaagtacgtattacatgcttagagcgacgcaatgttcccggaaagggcattcaacgcgcttgtcgcattggtatgctagtgttatgcgcgccgaaggacggctgggcgaagagatctagatcgatgtgagcccctggcacacaatcaaatcccggcctgacacggacatttattcacgtttctggatctgaggggctgctgcacgacgcgcagttggccgccagccggctggctgccggttggtgtgccggcttgtagatacgggtctggcctgaccaggtccaaaattttcagctggccgcgccgctggtgccagaggtggtccgttcgctgcgccagattggcgagtacatcctcgaggccaccggatagcggatcggggtggttcgccatcacccgagtggttgtgggtggcaagaattcgcctgagattatgaacacatgcggattgcgcagcacatcagtgacctcatcggcggcacgccactggtccgcctgaattctgtcgtcccggccggtaccggggtcgtagcggcaaaggtcgaatatttcaactccgggggcagctccaaggaccggatcgcggctaaaatgatcgatgcggcagaggccagcggtcagctgaagccgggcggcaccattgtcgaacctacgtcgggtaataccggtgttggtctggctttagtcgcccagcatcgcgggtataagtgtgtgttcgtctgccccgacaaagttagcgaggacaaacgagaatgtgctgttggcctacggagccgaggtagtcgtatgtccgacggccgtgccgcccgacgatccggacagctactacagcgtttccgaccggttggtcgccaagatcgacggtgcctggaaaccagaccagtacgccaacccagcaggaccggccagccattacgagaccactggcccggagatttgggccgacaccgacggtagggtaacccatttcgtcgctggcatcggtaccggtgggacaatcaccggcgtgggccgctacctcaaggaggtgtccggcggattggtacgtatcatcggtgccgatccggaagggtcagtgtattcgggcggtaccggacggccatatctggtcgagggggtgggcgaggacttctggccggcggcgtacgacccgatggtgcccgatcagatcatcgcggtgtctgactccgactcgttcaatatgaccaggcggttggcccgcgaagaagcgatgctggtcggcgggtcgtgtggcatggcggtcgtggctgctctgcaagtggccgaagaagccgggccggccgcgctggtcgtggtcttgctgccggacggcggccgtggctacatgtccaagatcttcaatgacgcctggatgtcgtcgtatgggttcctgcgtagccgtctggacgggtctaccgagcagcccatagtgggtgatgtgttgcgtcggaaatcgggcgcgttgcccgacttggtgcacacccatccgtcggagacggtgcgcgatgccattggcattctgcgtgagtacgcggtatcccagatcccggttgtcggcgccgagcctccggtgatggcgggcgaggttgtcggcagcgtctccgaacgggaactactttcggccgtgtttgaaggtcgtgccagcttggccgacgccgtctcggagcacatgggcccgccactacgactaatcggcgacggtgagttggttagtgtggccggtgaggcgctgcgcgactccgatgcgctgatggtggtggagaaaggcaaactggtcggggtcataacgcgatacgacttgttgggtttcctctcggagggcgcaccgctacgttagcgggatgatcgagccgcaagttagttcggctacaaaccaaacacggcgacgactcgatacgccgaaacccgtgcccgttcgctacgcgaatttgttctcaggtagggtaatgcggcctagttcagctcctccgcagtggaaggttacccatgaccgatcaaccgccgccgagcgggtctaacccgacacctgctccgcccccgcccgggtcatccggtgggtatgagccttcgtttgccccgtctgagctgggctctgcctacccgccgcctactgcgccacccgtcggtggttcttacccgccacctccgccgcccggcggttcttacccgccacctccgccgcccggcggttcttacccgccacctccgccttccaccggcgcgtacgcgccgcctccacctggaccggcgatccgctcactgcctaaggaggcctacacattctgggtcacccgggtgctggcttatgtcatcgacaacatcccagccacggtcctgctcggcattggcatgttgattcagacgctcacgaagcaagaggcgtgcgtcactgatatcacgcagtacaatgttaatcagtactgtgctactcagcctaccggcatcggcatgttggcgttctggttcgcatggttgatggcgacggcctacctggtctggaactacggctatcgccagggcgccaccggctccagcattggcaagacggtaatgaagttcaaggtgatcagcgaggctactgggcagccaatcggtttcggtatgtcggtggtgcgccagctcgcgcacttcgtcgatgcggtcatctgttgcatcgggttcttgttcccgctgtgggactccaaacggcaaaccctggcggacaagatcatgacgacggtgtgtctgccgatctgacacagtgccacgacttggcaggctagtcggcggccccccaaccgctgaccgcagcggccatctcttaggctaatcgtcgatgagcgaagattaccggggacaccacggcattaccggactagccaccaaagccatccatgctggctatcgtccggatccggcaacaggggcagtgaatgtcccgatttatgccagtagtacttttgcccaagatggcgtcggtgagttgcgtggcggattcgaatacgcgcgtaccggcaaccccatgcgcgccgctttagaggcatccttggccacggtcgaagagggcgtttttgcgcgagccttcagttccggaatggctgctagcgactgtgccttgcgggtcatgctgcggccgggggaccacgtgatcatcccggatgacgtctacggcggcaccttccggctgatagacaaggtctttactcaatggaacgttgactacacgccggtaccgctgtctgatttggacgcggtccgcgccgcgatcacatcacggacccggctgatatgggtggaaacaccgaccaatccgctgctgtccatcgcagatatcaccagcatcggcgaactaggcaaaaagcactcagtaaaggtgttggtggacaacacctttgcttcacccgcgctgcaacagccgctgatgctgggggcagacgtcgtgttgcactcgaccacaaagtacatcggcggccactctgatgtggtgggcggcgcgctagtcaccaacgacgaagagctggaccaggctttcggcttcttgcagaacggagccggtgcggtgccgagcccgttcgacgcgtacctaacgatgcgcggattgaagactttagtgctgcggatgcagcggcacaacgaaaatgccattactgtagcggaattcctggctgggcatccgtcggtgagcgccgtgctgtatccgggcttgcccagccatcccgggcatgaggtcgctgcacggcagatgcgcggcttcggcggcatggtttcgttgcggatgcgagccggccgactagccgcccaggatctgtgtgcccgcaccaaggtgtttaccttggctgaatccttgggtggagtggagtcgctgattgagcagcccagtgccatgacgcacgcgtcgacaaccgggtcgcaattggaagtacccgacgacctggtgcggctttcggtcggtattgaagacgtcggcgacctgctgtgcgacctcaagcaggcgttaaactaactgcgccgactgtgaatctgatgacgcgacgccggccgtcgcgggattcacacttgcgataattatgagtggtaaggctcagcgctgatcaacgtgacttgaacggtgttgccattgggtacggtgtagctgcgagtctcacccaccttggcgtcgatcagggcgccccccagtggtgaatttggcgagtaaacctcgagcttgccctcgttgacgccctcctggcgagtggctatgaggaatgtctcggtgtcggacttgtcgtcgttgtagtagaccttgaccaccgaaccgggcagcgccacgccggactgcttgggcgcttcaccgaccttcgcgatgttgagtagatcttgcagctggcggatgcgggcttcctgctggccctgttcctcgcgggcggcgtgatatccgccgttctcgcgcaggtcaccctcctcgcggcggtcgttgatttccgcggcgatgaccggacgatttgcgatcaactggtcgagttcggcctttagtcggtcatgtgactcctgggtcaaccaggtcacctgagtatccgtcatttcgtcgtgctccttgtgttctcggcttcgcttatccgcgtaagtatttgattccccgctgcccagggggcgtatccgggtcaccccgtgtagctgctgttccgtttcgctcatggctaccaatgcagcagtcaatacacggtcccagcaggaaccgtgtattgactcatgctaccaccgcgaaaacagctggtgacgtcgcccgttagcatttgtcgtttagtcaggctgggcgcaggtagcccggtacatcggttccgcagccatagatatcggccatcaccggtggtcgggcggatttcaccgtcgtaactacctgaaccgtggtcgcctcggctggtgctaccaacacttcacgtctacctgtttcgctgccgtctttggcacgaactcgcacaatgcaatctaccggacgtgacgggtcggagcgcatcacgcttatcgtcaccgacaccgtctcgtcgtcgagaactcggtagctggcgagcgagcccgcaacgtcgctggtgccgagccgttggtaaccgatgacagcgatgccagtgctggcagcaacagccaacacggtcagcgcgatgacgccacggtgccgtgatctgccgggcagtcgggaacgtccgtaccgggtctcagtaagtggggtgaaagcttggttcatgagtggcttgtcggatgccgtaccctggccaacaggatgcaatgatctagcagtggaattatatataggctcaggagtcgaccggcgaacggacaagggggcctgtgagcgaactgcgcttgatggcggtacacgctcaccctgacgacgaatccagcaagggcgctgccactctcgcacgttacgccgacgagggccatcgggtgctggtggtgacgttgacaggcggtgaacgtggcgaaattcttaacccggcaatggacctgcctgatgtacatggacatattgccgaaattcgccgcgacgagatggcgaaggcagccgagatcctcggcgtggagcacacttggctgggcttcatcgattccggcttacccaagggtgacccgccgcccccgttgcccgacgattgctttgcgctggtgccgctggaggtgtgcaccgaggcgttggtgcgggtggttcgcaagtttcgtccgcacgtgctgaccacttacgatgagaatggcggctacccgcatcccgatcacattcgctgccaccaggtctcggttgatgcctacgaggctgcctgcgactatcggcgttttccggacgccggcaagccgtggacggtgtccaagctgtactacaaccacggcttcctgcgggctcggatgcagttgctgcacgatgaatttgctaagcatggtcaagccggcccattcgacaagtggctcgcgcaatcgaaccccgcgcacgacccgtttgagtcccgggtgacgactcgggtcgagtgctcggcgtatttcagccagcgcgacgacgctttgcgggcgcatgctacccagatcgaccccaaagccgaatttttcgcagcgccaatatcctggcagcagcggctatggccgaccgaggaattcgaattggcccgctcgcgagtccccactcggttgccggagcacgatttgttcgctggaatcgaggcggccgggtgagccatatctttctcacattgattgctgatggtgaattgcagtatcatgggcccgattttggcaaggcgagcccgatgggcctgctagttatcgtgttgctgttagtcgccacgttgttgctattgtggtcaatgaatcgacagcttaaaaagatccccgcatcattcgactctgaacaccccgagctggaccaggccgccgacgaaggcaccgaactggggggctatcttgatgaagagccctccgacaccgatcgcaacggaccttcgctaccaccggaacccggcgctgactccggctgattcgccccgggcaaatatcctgggtctgatgaccagtccgtatttgtgccggcatactggaaacccggtgcattggcagcagtggacgtcacgggtattggcgggtatggctgcgcgtgatgtgccgatcctgttgtccgccggctacgccataatcgatcactggtgtcacatcactgatgccttactgcctaccgtttttttgcggcacttactatcccaaagtcgctttcttgcaaattctttcggttatttctgacgcctggcaggacttccgtgccggcgtcgaggaggcatccgagcacatccctacatcgaccgatgagttgcgctcgatggctggggcactcagtgcgctcctggagccgcacggtggtggttctgcggtgacgtcgacattgtgcgattaacgccgtggcaaccgtgctgcacgaccaggacactgctcgtggtggtttccacggagcgcccaagttctcgccgtcggcgatggtggaggaggttgcacgtgctgggagtgcgatggcccggtgcggcgtttacgaccaactcgacggcgggtttgtccggtgcggcgttgacgacgcttggggcttgggtgatactgcatctcgggaagatgttgttattacgacgtaaacgtactattgttgtgcccgtatgcgccttgggtccatagcaccggagtccggttaactcgccgggtcgccgcgccgaccgcccgtttgttgctcgacgagctggccgatgcgggaatgttcacttcgttactggatactgccgccgacggtcgtgagggctcgacccatgtctggacgccagcgcatctaaccgaggtgctagacgacgaggacggccgttggacctgggacgttttcaccgtcaccggatccctccgaacatggggcggcggtgctgtatctgcatggggatccggattcgcaacgactgtaacggaccggaccgcgctgttggctgcgcggcttacccgcgcacaacccggacgcgatgacaagattgtcgtttcctggcggtaaccgccctgagctagatcagtgtgccattgtaaaaaactctaattagagcgagccgggcgggactctgctacagcgttgccgaacttgcatatggccgacgatggtgggccagcctgggctgggtggtcggcgacagcgcggtgatccatgaaggccatgctatgttggttaacgtactggcaaattgtaccagctgacttccgataaagtctggtggctacggtgattgacccgcttgacaccgcgttgcggcattttgctcacgtgacgcgtcctgaccgctggttcggacaccaccgacaccgtggacgacgccaagaagctgacagctgtggcctgacgatacgcaggatggctgacgccgtaggggccgtcgatcactgaggcactgctgacccgttgcagattacgatcgcctataaaccatcgcagtcatctttattggtctattggccgacgcgcgtcggacggagcgatagtcgtcagtggtgacactaactcgtcaacgctgctcgtcagtaggaaccgggtggccggtgccgctgtggcccacgtatgccacggatgaatctgcgatcgaccggtcactagagtatcggatctaccggcatccgggcttacgtgaactagttcgacgttaaggcgtgttggtgttcggtggcacgcacgttcggattgacggggttgaattgtactttgtgtgcatgttctgttgtgggggtggagtaaagggtggcggtgtgttgcagtgttgtgagttgatgtgatcgatcgttaaccgttcgtttgggttgggtgggggtggggatcgtgcgtgagatcaccagcaagggtggggcccgcgtgtttgcgggttgctttgggggttgcactgattcgacaccaactatgctggctaagacgctcaatcgggttactgagcttgtattgcttagctatgcagtgagcagtgggccagtggctttaaaggccggcaaggtgagcgttgtgggcagctgcgtacggagatagacatgtgtgctggccaagaagtacagtcccgaacaaattgtgggggtgttggcccaaaacctatcccgaccggcccgaaagatgcaggtgtcctataaaacacttcaacatcgagtccaagctcaaccaacatgtgcgcactgggtggatgttccgcacgctgagggcacagcacgctaaaaccgggcaccaccattattctctaggtatggccaccaccagtgcacgtcccgcgaaaactacacgaccgtgtggtgctctaacctcatagcattgggcggatgatgtaatcatcggcaaaaattagacccccaaatcggcgccctggccgaacacaagtagcggattcgtgcagctgctacacctatccaaggaccacagcactgatgtgatcactgcggccatgatcaaccacaagacaacgccctaccacagaatcgctgtacaaccccagcgtgagaccaagacctcgaaacgactctcatacccgcatcaccacggcatcgataccgacctttgcgacctgacgcaccgacccgccaatacactgacccaccaccctttactccacccccacaacagaacacaaagtacaatttgcggtagtcaccggtgacaacttccaacaactaagaatccaacccttacaggtaaattttggccaacactgccaatgtcaggaccaccggaaataccggtagaccgaaagtgaacgccccccaggcatgcttacggcgctgacgtaaccaccatccgcacatcccggagcagaataccgacaccatcgacaggatcaacacgatcaggctccactgactgactgtcgtgatgttatatccgatcgacatgaccacaagccagagtacgtagccggtggccaccccgccgatggctcccactgcgatctcgggggtgtcgttgccaatcaatcggttgtctccagccgccacaagccgttactgaatgctcagaagttgatcatatggccgattaggccgtgaaagcactcctgcagcgcctctgacagcgtcggatgcgtatgcacgttgcgaaccagctcggtggccgtcaaatcccatttctgcgcgagcgtgagctccggtagtaactcggacacgttatggccgatcatgtgcccgcccaacagctccccatacttggcgtccgcaacgagcttgacgaaaccgctggggtcacccatgccgtgcgctttcgcgttggcagtaaacgggaacttagcgactacgacgtcataacccccgtctcgggcttgctgctcggtcagcccgaagctggccacattcggctggcagaacgttgcgcgtggcatcatacggtagtcactgagcgccaaagtctctgcgccggcgatagcctcggccgcaaccaccccttgggcttcggcaacatgggccagctgcagcttaccggtaacatcgccgatggcatagatgtgcgaaacattggtttgcatatagtcatcgatgtcgaccgccttgtcggcggtcaaagctaccccgaccttgtccagtccgtaaccgtcgacgttgggagcaaacccgatggcctgcaacactttgtcggccttgagttcctggaattgtccgtccttgctgacagccaccaagacatgcgaaccgttgtcagagatggactccactttggttccggtaaggattttgatgcccatcttcttgaattgcttctcgatctccttagacacttcggcgtcctcgttgggcatcgcgcgcggcaggaattccacgatcgtcacgtcgacaccgtagttcttcaggacgtagccgaattctataccgatggcccctgcaccgacgatgacgatcgagtcgggaagctcccgggtcaggatctgctcctcgtaggtaatcacgttggtcgacagcaacgtgccaggcaccagccgggttttactgccggtggcgatgatgacgttgttgaacgtgacctttagcggagtttcagggacgccttccgacaattcaacggacaacgtgttggcgtcggtgaatctgccgtagccgtgtatctcggtgatcttgtttttcttcatcaggaagtgcacgccggcgacgcgaccctcggacaccttgcggctacggtcgtaggcaatcccgtagtcgaagctggcatcgccgctgatgccgaaagtcttcgcctctttagtgaagatgtgtgcgagttcggcgttgtgcaataacaccttggacgggatgcagccgacgttgaggcagatccctccccagtacttgggttcgacgactgctgtgctcaagccgagctgtgcagcacgaatggcagcgacatatccgcccggaccggctccgagcacaacgacatcatagtgagtcacgacagctacactagtggccggctacgcggtgacctctgaacgggtcacgcgcgtacttgaacgtgcgaaccgagatccgctgggcgtcagtaggaacgacaccaaaccagacagtgagcgacccgttcgtactaaatatgtttagtagttagttcatagatttcataaatgaggggtctccgcggcgacgaaggcaaaaaggggcctgacagcaccgcaagtgccaaacgtcgtgataagctcactttccagggactagcatcacgcctgccagggtgcgtccgacgacatagactagcaccataaaccataaatagcggcgctgtcgtgtcaatcgagtgataccatacaataaaatcagggtgagcccgatctccgcgacggcgattaatacatcgaggatcgccgtaaccaacttccaccacttcagataactggtaacgaccggctactgcaaccggtacggcagccaactcggctgctaaattctcgtctcgctagccactgccaggtcagatttctccggcccggtgtatgagtggcggctgctgcgagtcaatgccatcaaaatcaagcttgaacaggactgactccttgtcgatgttgacatcagggacgaacggttaagttcccgtgctgggtttgcgatctgggtcgatgtcttcgtcagccacgagacgtaatttcgatagcggcgagcgcacctaaacaacctggcgccaccgcgaggatgaaaatgagcctagaatcgctacccatcgacacccggaaaacagaattaagcgtcctgtaccagtcacactgggaataccgaacccaagggcaatgacgacgtcgggccggatcctctgatgaaccaacacggtgcacgccactccagtcagcagctcgaccgtgcttccgatcagcagcgcgctggccagccaggggcgcgcggtacaacggtggcgatcatactgcggttaccaatgaccggtgcggagcgatcacgggcccggccgcgtgctccaagttcaccacctgaccgcgctaaggtggcccgttcgcctcccgcgtaggcgttgccagtggtgatcggtgtgtgcctgcaatggcgccttcttcgcgccggtgcaagcccgaccgcgactgaggaaccgcacgcttttcgctgtttccagactgaacccacagccgcagcacagaaccacattgaggaccagctaggtgcgtttgtctccttggtagtcggcctggtactgcggttaaaatctacactgggatcccttggccgacatcgagcacgttgagcaagacgtcacggttgccgataacgaagtctgcacgtgggtagcccatcggcgatgacctaccgaagcagcctccggactggtggaacagcactattccgtgctggtcttgcagggaaaccaccccgccggcggggtggtttggggcgcaaccatcagaaaaataccagcgccttgtccgaattaggacactaaacagattctttgtctgtcggtatatggtcgagcatcatattttgggtctcgcgggcgaaacctgcctggcttgtagccgtcgaaggccgcgtgggcgtgatagggtttatagcagttgatccacatttcgctggcttgagtgtcccggctgggccccggtaggcgatattgcaatcgcggctccacatcccaacaccaagactgtaaggggtgtcgttgtcgatactatataaagtcgccatcggtgaacggtgacatcgcgatcatcgccccgaagaattcctcctggaagatctttatcttggcgttgccggcaatgatcgccgagtatacataaaacccgcaggccaggttcttgcccagatcggcccgctcaccaccggtgatccgggtgggacgctctcgtctttgtcgatctctattgtatgtaagacaacaccttctctagctgatcgttggaagcctgagaatccagcatcgcctcggtgtccaacgaattgacctggactgctttggtttggatcgccgccagtttcaaaactcgtcatagatatcggtctggaatcaggctgggcgatggcccggtgcacactctggttgatggctaacacggtgaatccttcggcgccttgtcttggaagttgtcgttgacgaccgtcatgtcggagaagaaggttattggggctctggccgtcgagttccaggctgcccgggacacctgcactggcataggtgtttgttcagccggtttgagcactaccgcattgcctggcgctagtttccaggcgcccattggtatggtgaagttccacggaatgatcttccccaccatgctgagcggatcacgtaaatgataggtgacagtgtcctcgtcgatttaagacagcgaaacttcctgggcgcagatcgcgtcggtgaaataccggaaatgttctgccgcaagcgtgatgtcggtggccagcacttccaggatcgggttgctgttatcccaagattcggttattgctaacgcggctatgtattagccaatacaattggtgatcttgttaaggatcgttttccactcggcaggggcgatcgtactccagaccgggcacagcgcagagctcctttttgatgccagcctcgtcagattgggctacctagcaaaacgtctgtccggtcaccgacgtcggattctcgacataactggccttggtggacggtcacccacttggccccataaaattatcgtaccgggattcatacgacatcggtgccccagcggagtccggacgtgggaaaaataatcctcagtttggtccctcgtttacttacagtaccaaatattctaatacacagagatgtaatgcaatgcatattaccgtcgacgccaccggtgtcttccctgacatcggaagtcgctcggacatccgcatcccactacccgtatctgtggttcagagagatcaccagtgtgaaggcgctggattgggtgcgcgcgcaacgaaccgacactggctgatttgtgcgatgcggagttcgagcggatgcacacctaggtgctcgacaccgatatctggatcctgtacatgaatcgtcgtggtgagtacctattacaacttctggcgcgatgccaccaacccccgccggctgtgacggcgcaccacactcaaacgttaccgtaacgattcccccgagtgggacgtgcttatcgatatcgatgaactagggcgaattgacaacgagaaatgggtgtgggctggctacttgcgtcatcatacctgaccacacgcggacgccgatcagcctctctcgaggtggcgtgatgcatcgctcatgtgtgaatttaacatgttgacaagcgaatccgtagttcacgtgttagaattaccggagggctaaatcagatgtaatttgggacgacctccaagataacgtgttggtgggcaacggctttggcgctgactcacttaccgagttcggctatacgcgaccgatcaagcgatggtgtctaaacacgccattggccgatgcaaagacctcttttgaggatggtaagctccgatgtcccgatctttgcgtccgtcgatcgaacgctaggcttcgcatgcaccttcatggggcgagcgctagctttatggaattagaagctctacgaacttcgcggctcggagctgcttagcatcgacaagcccaccgatgcgagcgcgtcgatctatcgcaattggctgttgattgcgctgcgcactgattggattttcggcactaacacttaccccacggtcttgctgttgtccgctaactatgacgaattcctcgacgacacagcaaaactgcgcgtggtgttcgagctctacgagcacacctcgctaaacatactctatgtggatccatgaccagctgttgatcgtcaacgcccgccgatgtggccagctgcgtctagatcgctacaccagatagctcgcaacgcgaaccattggcaggcatcccggtcaccgccaacaccgtactccaccgtcatcgtcgccgcgtacgagcacggcgacgggttctttctcgactccagcggattcgacacaccctctcgattgctgcggggcgcgaccaaatggacaactagatcaaatcaatttgacaccagctttcttagatgctgaaaacaccatcgtggccaaatgttttgtgctatcaacagaatggcaagttgattctgtacctagtggttcgacccggagacaccaaaaacagccgtggctgacactgttcaacggttatggtgggtttgtaaggtcatccagcacataaggatatgggagtgctggatcagccgtggctggaccacgagggtacttatatgctagtcactaatacgcggcgacggtgaatataggcctggctggaacacgcgggagacgctcgatggcttacacaaggttgccgaggatttcgtttcggtagcaaaagatttggtgaactgcggcatgacaggcgtcgagcagttcggctcacgcggcggcagcaacggcaggttactgatgggcgtcatgcggaccaaatatccagaaaagttcggcatactggtctgtgatatgtcagctggacatgcgctgctaccatcgactgttgaacggcgcttcctggatggcctgccatggcaagccggacaacctccacgactgggagttcatcgtttaatctttgttttattagagcatttcggtgacttggcagtatccgccggtgctgttcaccgcggcggccgggtgcatactggccattcccgcaagatgaccgcgaccctttaggcagccgggtctggtactacgaaaacagcgagggcgggcactcatgtggggccgacaacgagcagttagtgttgggggcgctcagttacgcattcctgtaccgcaggctaggggctgactcgcgcagcatatcgcggcaagggtcccgacttacttcgctgctgctatgactagaacccaatccggggtcaattttgatagcctgcattatgcggccaccggtccggtcgccaccatcacattggatagctcagagcaccttaatactatattaacgtcccacctattctcgacaagatcgagacgatcggcaggctggctgagcgagaccacggtatcaaagtctatagtgttgcgtggcgccagccagtccttttctgacggctataattttggcggcgggtttcagcaacgggggcgatggcctgatgacctacaggcaatggtatccaggcaaagagttcgctagagttaccgctcgtgagattcggcctatagagaggttcatggccatttaactagcctctaagccgatgatcgctaggcgcaaaactgatgcgtcgctgattttcagcaactacgcaaatgcactgacatcgccattaccgacaacaacgcgatgatcggcacccatataatcggatatagagcttatctaattgaaagcataaatatgcttgctcggccttgccaatgtcaagtggcacccgcttactggccggccgttgaccggtgtccaggaagctgaagtcaagctgataaacgaataggtgccgttcgaatgcctctaagcttgtgtcaccgagattgctgccgagctggtacgcatcctcattgtcgcagttgtgggcactaagcctgatcgttaatcaggccgcttgcgagatacatgaacctagcgtctacccagatgctaggtggcattctggatggcctgacgcgcaacatcccgacgcgctcgacttgatccgcgccaccgaaacccaaggggtacggatcgtgatcgcacgccgagacggcccgttcgacaattacagccaagccgtacccaaactacggccggacccctcaacatgtctattgttcctgctggctcgtaagcctagactagtaacttgctgtcgaagcactacttcaaaaccccgaaagggttacggttaatcaccatgtctcggctgagcaccagcctatgtaaaggtgctgtttttctcgttttcggtatcattcctgtggcatttccgacgaccgccgttgccgatggttccacggaggattttccgatcccccgcaggcaaatcgccaccacctgtgatgcagagcagtatttggcggccgtcagggataccagcccgatctactaccagcggtacatgatcgatatgcacaacaagccgactgacatccagcaggccgcggtcaatcgtatccattggttctattccttgagccccaccgaccgtaggcagtattccgaggacaccgctacaaacgtctactacgagcagatggccacgcattggggaaactgggcgaagattttcttcaataacaagggcgttgtcgccaaagccaccgaggtttgcaaccagtaccaggccggagacatgtcggtgtggaactggccgtagtcctgttctagtcgcgatttggcgctttacccgccgagtcggaccgattcgtgttgtcccccaatgcccaataggaggataatctaaattaagctattcggcggcgcgagcccgccgggtcggcaggaagaagtggcagttatcatgccttggtgcgcttgccgaactgcttaccgtgaggatttagatcgtgctcatcacagttatcggttatggaatcacgaccggctccgcgccgatgcagcttggtgcgggcgagacaatgcttgtcacatgagccaagtacctggtaacaagatcccggacacgcttgcttccctcgattggcatcagctcacgtgccaatcggaagcgggctgcaccaatccggctacccatatcgtgcaccggcacgccgtagatgaatgcagcaatccgaatctggacctgggcggaaacatcgtcgacatcttgtgcctctgctgtgtgcgcagcctcaggctcgtcgtgctgcggcaggtcagcaaactgactcgccaccggggtgcatattgtttgacgtgcggggcgccgttgcacgagctgcgcgacatcattcgcaacaccgtgcggttagccagctgacatggtttttaaccgcacttaccgtcattagtgcagtatggctgccaggagtcgaccggtgtttgcggcgccggctattttctcattcctgggcagcggcagtgcatgaaccaccgggtgggccgcagcaaccgcgatggacaccgagcccgcgtggtcacaccagctaacagttagtcgctgtacaccagggaccggtctggaggtaatccaaccggagcagccacggtcaacaacggtcgagtgcggccctgttgcggccaccagaaccagcgtcccagcagggcagcgatcgagggcatcatgaacgagcgcacgatcaacgtgtcgaacaatagacccagaccgatggtggtacccacctgcccgatcacccgcaggtcgctgacgaccatggatgccatcgtgaacgcgaacaccagcccagcgttcgtcacgactttgccggtgccgcccatcgaacggatgatgccggtcttcaatccggcctggatttcctgtttgaaccgcgacaccagcagcaggttgtagtcagatcctaccgccaacagcacgataaccgacatcgcaagcaccagatagtgcaattcgataccgagaatatgctgccagagcaatacggacagtccaaaggaggcgcctagtgaaagcgcgaccgtacccacgataacagcggcggctacaaaggctcgagtaatgatcagcatgatgatgaaaatcaggcaaagcgatgaaatccccgcgatcacgagatcccagttagcgccctcgtcgatgtccttgaagacggccgccgtaccggccaggtagatcttggtgtcctccaatggggtgcccttgagagcctcctcggctgccgtgcgtatcgcgttgatactcgcgatacccgcgacgctggcgggatccccccgatgtaaaataatgaagcgagccgcgtgtccatccgatgacaggaatgatttcatcgcgcgcttgaaatcggtgttcttgaagacctcgggtggaaggtaaaatgagtcgtcatttttggcagtgtcgaatgccttccccatcgtattggcgttgtcgctcagctcgttcatctgatcaaagatcccagacattgtgctgtgcatggtcagcatgatggtgcgcatgctctccatgctttcgatcatcggcgggaattgctccaacatctgcggcatcagcagatccatgtttttgatgtcaccaacgatcgagttcagtctctcgtcgatctggtccacgccgtccagcgcatcgaatattgatcgaaatgaccagcatatcggaatgttaaaacaatgtctttcccagtagaaatagctacgaatcggtcgccagaaatcatcaaaattagctatttcatcacgcaacttgctggtagttttttgcatttctacagtgtcgtttaaaatgtggtgagtattttctgtgagcaacgccattaattgatgcatacgcctcatcgaagcaatcgtttcggccatattttctgcctgtcttagaaggtcattcatccggtccttctgatacttcatggtttgtacttgtccggcattttgcatgcttatctgaaatggtatcgaagtatgatccattgccgttccgtcgggtctggttatcgcctggacccgggaaattcctggaacacgaaagattcccctggccagcttgtccaggatcaaaaagtcggccggatttcgcatatcatgatccgactcgatcattaaaatttcgggcttcatccgggcctgtgggaaatggcgatccgcggcggcaaatccttggttggcggggatggacgcaggaagatacgcccggtccttgtagttagtccggtatccgggcagagccagcagaccgaccatggcgatagcgcaggtggtgatgagaatgggcagcggccagcggaccaccacggtgccgatccgtcgccagccacggaccttgatcagccttttgggttcaaacagaccgaaacggctgccgaccgtcaacaccgccggtccgagggtgagtgcgaccgccacggcgatgagcatccccaccgcgcacgggacacccaaagtttggaaatagggcatccgggcgaagctgaggcaaaacgtcgccccggagattgtcaacccagagcctaagatgacgtggaaagttccccggtacatagtgtagaaggccgcttctttgttttcgttggcctggcgggcctcctggtagcgcccagtgataaatatcccgtagtcagtgcccgccgcgatggccaaggatgtgagcagattcaccgcgaaggtggacagaccgatgagcccggtatgtccgagcaacgcgacgactccccgcgccaccgccgattcgatcccgaccgtgaaaagcagcagaatcacggtgatgaacgatcgatagacgagcagcaacgtcaccaaaatcacgatcacactcgttgcggtgatccggatcatggatttgtcgccactatgatgcatgtccgcgatcaaggctgacgctccagtgacccaagccgttattccgggaggcgcaggcgtctgcacgacgattttgcggaccgcatcgatggattcttgagccagcaactcaccttggttacccgctagactcaattggacataggcggccttaccgtcattgctttgggcgccgggcgcggtaagaggatccccccaaaagtcttgaacgctttgcacgtgcttgtctgcccgcaacttgcgaatcaggccatcgtaaaatctgtgagcatcgtcaccgagcggcttatcgccttccaggacgatcattattacactgtcggagtttccttcgttgaagacctgacccatcttctgcatcgcaatgtacgacggtgcgtccttagggcttagcgacactgaacgctcttgcccaacgtcttctagtgatgggataaagacactaacggtgacggcaatggctaaccataccaagatgatcggtaccgcaaatctgtggatcatccttgcgacgaacggtggcttggtgtgggtgtccaggtcgttcgcgcatttgaccgtcacgcggacttcaccaggcagtaggtgtaggcgttgacttcgttggaaactcgctcagctttgactacgccgtccacgatgatccggcagccgatactatcagtattgccctgagccacgaggtttcccatcactgcggccaaggtcgtggtcataagtaacgaccatggcaattgtgccccatcgattcgctgggggtcggaattagcatcgaaatagctgatatctgcaaccgttccgggtgggccgaagacctcgtaaacaatctgcttggggttgaacggcttgctgcttcccaggttgctatctgcgtaggattcgcgtttctcggaggcgaaataactgtggacacggtacactacgaatcccccaaccacgagcaccacaaggatgacaagtggaatccaaattcgtgacaacagcttgaaaattgaaatccccttaccccgttggcgtttggacattgacggcccgatgtccgctcgaccaagttcaacttcagatcgtggtgccggactacccggaccacaagctcagatcgccacacctttgtgatggtcggttcgaaccgaaggcgtttgggccggagtacaatcaagtcttgccaaagtaaatcacggggccttgttgcttccttcctgccgggctcttggaaagagtaacgcatatatcatgcgtaacggcgcactgctgtgccgctggcaaatcatgcccgtgcgttatgcaaatcacattctgtgaattattcctatggtggtggcacaacttacgttccagcgctcccgtaccgagggaaacaagcgtcaacggccggccgcggtcgtggaaaccgcatgcccactggcgcttgagaccggtgtgacttcggtgacgttgactgctgacgccggccatgccggaattcattactccgcggtgcgtcgctacttcacctcttataaacataaactataaatataaatgaagtactgctatacctcgccgccgagggtgggatacgttggtcgaatacggtgtgtgaaacgtcggcgaaatccggtccgaggtcaccatcgcggatcgctgagacgttggccaacgtcctgggcgctgttctgcgatttgctcgccaatctgcactgcatcttgaacacgaagtggacgtcgaggtcaagtgggccagtaccactgccgtgattaccttggcgtacgcaatccagcaacatgttgcccgtgctcgggcgttcgggtgcattagacatacttgctggctgcctgttctctggcggctaccgtgtggcaaatcgcgcacccccagagcagctcactgacgcttatgccggataaccggagatcctcccatccgagtgaaaccttgactttgccacagcgctgactcgatttctcactgctacttgccttggcctcatcgccgaatcgcagtgagcagaaacagacgttgtgctgtggcgaagcaaatggacgttgaccaccggtgccttgtgcgacgttcaggtgaggggcattttagcgggctttcttatctgggacaggaacggtttcggctgatgccaatgcgggggcaaacgatggttaaagcggtcgcacgagcaatggggcgccaataagtgaaagacgattgagtggccaagattccggttgctgtcgcggagcgagaagtgcggatcgtgatcgtggttgcagtaatggagttcggtgtttatctgctccgcagcttcttcttttactttcacgacaacaaggcggttaccaatggctttccgctgacatcccagccgtttaataccaaacacttagtccactaattttatggccccgccagtactgtggccaacgccaatatatatatatatatatatgcccaactgtaacgggtaagttaatccgacgctgccctggacgctttcggtcgaccacaacactttccgtcggtaaacccgtgccacaaccgtcggaaaagaacatacggtatcaatgaccaccaacgatacaccggccatgcaggcgatgaagcgggccagccaaatgttcaataagttcaacaccgacagtgctattattatcgtcctaaaagacgacaaaacagattgacgatgagacccaccacgataataaataatacagcgagttaatccggacgtcttggtggataaaagcagactcagcacgtcacaaaactgctggaggacccattgacggtggccgggtcgcaaagctcggacaatcaagcggtctatgtgcaaatgtatctggccagtaaccagggcaaaaacttagccaacgagtctgtccaacaaatcgtgaacggcacgccggcgctgtcggacatcaaggcctacatgatcggtggtgcggttccagccggtgccgatcagtcaacggcgggtgagcacagggttcaacaagtcacgatgatcaccttcctagtggacattgttatgttgctttttgtctactgttctgttgttcaggtgaacctgaccctcgtgatggtggtaattgagctcatggtggcccggcaaggtatcatttttcagcttataataacaccattggactatcacaaccttagcggtaaatctgcttgtaccgctggccattgaaccgtgagctgactatgcactattagtccttagatggtctcaagaggcacgcactctcggtaaggacggggaaaaactttctacaccatgttccatggaactgcgcacgttgccatcggttcgggtctgaccataaccgatgctatgtactgcctctgcttcacccggttgccctatttccgaacgctcggcttgctgtgctccgtaggaatgctggtcgtcatgatctcggcgaccacggtgaagtgagccgtccttactatcgacagttttccatttattagacccaaacggaagttgcggacccgtggatggccacaggtgggtaccgttagcctgagcaaattcttgctatgtctgtcgtgattgctcttatcgaattgctctatttgcttgggtacaagactaattaagacaatttctgttattttcctaaaagcaccacgagaaaatcgaatctaccgacactgcccggaatttttcccaggcccggataaagccaaaattgctaatgatcgagaccgaccacaacataccatgttttaacattccgatatgctggtcatttcgatcaatattcgatgcgctggacggcgtggaccagatcgacgagagactgaactcgatcgttggtgacatcaaaaacatggatctgctgatgccgcagatgttggagcaattcccgccgatgatcgaaagcatggagagcatgcgcaccatcatgctgaccatgcacagcacaatgtctgggatctttgatcagatgaacgagctgagcgacaacgccaatacgatggggaaggcattcgacactgccaaaaatgacgactcattttaccttccacccgaggtcttcaagaacaccgatttcaagcgcgcgatgaaatcattcctgtcatcggatggacacgcggctcgcttcattattttacatcggggggatcccgccagcgtcgcgggtatcgcgagtatcaacgcgatacgcacggcagccgaggaggctctcaagggcaccccattggaggacaccaagatctacctggccggtacggcggccgtcttcaaggacatcgacgagggcgctaactgggatctcgtgatcgcggggatttcatcgctttgcctgattttcatcatcatgctgatcattactcgagcctttgtagccgccgctgttatcgtgggtacggtcgcgctttcactaggcgcctcctttggactgtccgtattgctctggcagcatattctcggtatcgaattgcactatctggtgcttgcgatgtcggttatcgtgctgttggcggtaggatctgactacaacctgctgctggtgtcgcggttcaaacaggaaatccaggccggattgaagaccggcatcatccgttcgatgggcggcaccggcaaagtcgtgacgaacgctgggctggtgttcgcgttcacgatggcatccatggtcgtcagcgacctgcgggtgatcgggcaggtgggtaccaccatcggtctgggtctattgttcgacacgttgatcgtgcgctcgttcatgatgccctcgatcgctgccctgctgggacgctggttctggtggccgcaacagggccgcactcgaccgttgttgaccgtggctgctccggttggattacctccagaccggtccctggtgtacagcgactaactgttagctggtgtgaccacgcgggctcggtgtccatcgcggttgctgcggcccacccgtaatctcaccctatccgcatagcaagctatacacacgatcgcgctagatcggattttgagtggcctgattaccggaatgtcgccgtgcatcttgccggtgctttcggtgatgttcttgttcagcttaaacgccaccgaagaactgatctactaactgcttgttgctgctaatccggatatttcattgccagacccaacacagtcggtcaacaccaccccgcacaccaggctcacgccctaaacctacctgggtgttgggtaaaagcggagactaccccggctacggcaaatatcaggtgggcagcgcaacgttcggatacttggacgagttgacctactatgcattcgctctgcgcagcacctggaatttagaggaccaggacgccatcgccgacaacgacgatgacgccattcggctgaactatattgcttaaagtcgtcttcaccgaccgctgggttgctgttccctgagggccgcatcaccgcactgcgacaagcgcgtgtactcgggcatgtctttaccccgttgagcgtatcttttgataccgcgcccgcgacgggcttatgtgccattcggtcggcgaagtgcacgatacctacggtgaacgctatattttaaaatttattactacttgattaccatcagccgaccagcctgtggcgacggcaaaagcctgctacgtttccccgttcaatcaggtggatggtcttattcggtgcacgcaccacaacccgacagcaaggtccacatcaccgttaccttgcaccataatcaccggtcgactcctatagctatagccagcctgcgcgtcgaccgacaacaacccggcaagtagctatcatgcaaataatttcaccgctggcaccgttgtcggtggcgacgcatagccgaatacagggaatcacattgtggttaagccgatttctggtggtggcctgtcaccatctgttcgtggagtttctctaccaggccatgacgtactcatgcgcgttattaacccaactgccaactcgaacatcccggtggcgcgatttggctgcgactcaacgacgcaagatcaaccgtctgctcaatatggccggagtctaaaagcgaccagacaggtgctcgaaataggaattgggtgggtcggctgggcatacacgcggccacttgtggagcctacgcccgctcagttatcttactcatcaagcagcagtgtcctgacgtgacaacgtgccgtcatagtcgggttgtcgtatcaagtcgagattgacctacgctatgtaccgcgacgtcgatagaagctatgactttctagtggtccttggttgttagaacgttgagaattgtgttgggggtgttagactgcgttcggtaagagtagatggtttcgccggtgtggataccattgtatgggctcggtattttgttacgccttggaaaggctggtaggcgcacctcgtgatcaaggcgataaccatgccgaacgcactgatgttggccgtttgcaacacactttggattcacgaagtacatcttcttctctgacgtccttccacccttcacggaggccatcgtcggtatcaccgagcgacacaactgggtacgtgctgtcgatatgaccctattgcgtacgcatcatgccgaaattctgcgactctggcagggtaggttcatgtagccgctatatacattggagcacttggtttttcgacgaggttgtcgagaagatgcagatgtacgatctgtaccgcggtatatgcgaagttgggcttctgggtcggttatctaggtgtctaccagtgaacgttcgcgcgcggcgggagttgtgaacgatgacggcattcgggtgattgcaaacgtttcggtgttagcggctggcggtggtgcattcgatcacgtttgccatcggtaggaggtcggggcactacaacatcattgatgtggcatggaacctgggctttgtcgccgtggctgctgctagtgctgtcgccgacctgggctctgcggctgagctagttcatttaccgcaagaaggctggcaagagcgcggggacacgctacgccaacctgttgcacgacgccgcggcgggtcacgtggtataaagaatctttctcttacatggcttcttgatgctatttgtttcattactgctacagttatcgggaattctcagctgcggatatttaatccgactcggccaattgccgggttcattatggaccgcgacctgtgagcctggacgctccaccccaactactttggtgacgtctgcgtgtggtgggttttgtgactcgagcacgatcaacggctgggtatcgttggccaggatggtttcatcgttggtgatagcccatttcctgatgtacttgagcggggaccaactcaccgataagtacatgaaagaccgtctcggttgcgcctaaatatcaaaagctaacggcatatttcatgcaccgacaaccgcgcgtgctcgtcgcgcgctatcttgtcattaagacgcgggtctacagacccgtgatacggtcgctgcgtggttcgggctacagcgaagaaaccactcaggatgtctacttacaaggtgtcgtgagtggcgtgagaatagtactctgacaagagcgggcagtggggcgctggcgtggtgatgggtcaagcagtgtcggtgggtaagacggtggtcgtgtttcccggacagggtgcgcagcgaagaagccggcagccgccggaatcgtattacgctgtggccagtgtagacccggccagcgccgcggagcacgacctggtcccttagtcggcgatgaccaatgacgagcgttgtcgggtaactcgtctacctggaggcgttgtcggtgggacgcagccgcttttaccaactaagttctagccgtccgcgagaccatggcggtaatgttgggcggcgatcaccggctgtaccgcaggaacagcttcgtgcggccaaactcgccgcggtgaaacccgatacggggtcgggccggttacgtaggcgtccaacagtattggcggccgcggcaacgatcgtagtgaccccggacacgtttgccgccggggtgttgatgtcgccccgcgtccttcctcgctgctggccgcaccgatctcgacctcgagaatgaccttggcggccccggatgtgcggaccgtctttgtttcgtaggctaccgggacggccacgatgatgtgctcgttgcgatcgaaacacgggcgcgctggtgattaacaacatgccgtcgccgttgccggactaccgtttactatttgtggcgatcggcctcaaggtcgaacatccgcaggaacaatgggcaccgagccgtggcgccctcgtcagcggttagaccatctaggtaggcagcgccctgacccccgtcgtccgcgcacggggtaacggatgggaaactgcggagttgacttcgcgctgtgcagccaagaagaccacgacgtactcgtcgacgtgatggctggggtgtcgtggacattctctagagtgttgtggtgactgacggcctgccgtggaccggtaaacttttctttgagtatttgttatgccctggaagccgacaaacgtgatattgatgtcgctacttactttgccgccttctccgctgcgggtctacgttatgagttagcgcggagccgactgcgaaccagccactactggaaatttcgcgtaaatgcgcacgttggccgaagcaagctatggagattggagcgttgggcttcgcgtagcagctgctgaccatacaccagaccgagagcggatcaaccgatcccgagctacgacaccacccgcgaggagatttaaagggatcaccaagggggtggtcgatggcggcggtggccggctccaatgcgtgactgacattcctgcagcaccggctatcagccggtgctgcaggaggttttcgatgtcgtcgaggagatccggcttgtcggtcactttcacgatggttttcgcctacgcgggtgacccaacgcgaccggataaagaaggccagtaaattagggttggagctggcggttttgcaattcacccgcgcagttattgccgcgtacgatcggattgcagctcttcgtcaacccgttcgtgttataccccagctaccgcggaatcgcccagctagcgttggccgagcacgtcgtgcagatacgctggcccgaggttagcgcccgcatcctggccgacaagcctgggcatgatcatccgatcctgtacgtggcgcaggcacagtactggatttcccactaggggaccaaccccaataacgaactcgaccggcgattactacatagccactcgtacccgcggctgtcgtcgaaaacccgatgtaagtctcctacatcgggttctcgacgacggtaatgtcatgctgcttgccgcgaccagcaacctagaagacaactcacgagacatcgtcggaaagctactgcaccgcgacggcggcacatgctacggcatgatctgcgacactagctacccgactgctcttcctggcgtgattgggcatgtgactgggcgcgtggacggttctcgttgcctgtgaaatcacctccttgccggcctgcgtcgccggcacggccgaccgcggccggatcgcagtcggctacaaggccccgacctgaacgtcatcgaccacatcacccttcgggtgtataagccggtgatcaactacgaccagatcgccgagagctacgtcgcgaccgtggttgtcggccaagtatgtagtcgacaacaggttgccgaccgatgcccgtcccggcaatctggtacatgtcctgcaatccacgccccagtgcggatgatacggttacggtagtggtctttaccattaagtttgagttgtgacacatcggcatcacgtttggttgccgactgaaatcaattcggtactcatgttcgttggtcccggatcggggccactgcttgctgcagcaaaaaccagttgtccgaggaccttctgtcgtcggcagcgatgctggctgcggcgacgccaacgtggatgatttagtgcagcactcaggccactacagccgtgttcgaggcgacagtagcgaccacagtctagcttgcggtggtggcggtcaatcgggtcctagtgcaagtgttagcggccacaagctggttggtgcaaaacaggctcccgtgatcgtcgacatctaagccgcgtacaagaataatgtgggcgtgggaagtagatgcgatgttcggggtaccacgcctgcgtgtctacagcggctgagcaattggcttcggggcagcgaacgttgcgctaccttggtatcagcatcggcacgaatagcgcaagcttcgcgagtggtaacgtccgcagcggaaccgcgggcatcacccaagtcaccggcgtgaccccggtactaggaaaccctcggctggtagacgcccggactgggcggcccgggcaacgtcagcttcttccactccggccgctgctacgtaacgggtggtctcaacggggcaaatctaaactcgatcttgctcaacgcagccgcgccaaaccaggctatagccgttatcatcttatcatcggattcgagtcgggtaacccgaacctcggccggcgtcggaagcgcaactggtcctagctcggccctcagaaactccgtacgaatgcctttaacagcggatatcctggtctcaggctttttcaacaaggcaaccagcgccaccggcatcatgagctcagacaccaggcgccggttccatccggagtaagctcactgcatcgcatcctttggcgcctgtcctcgaagccgtgggcgcgaggaaggtggacctcaagcggctagccagcagctctcaccgactacctgttcacctaatctgatcatcgtcgctgtcggtctttgtgcgagtcagcatcggacggggcattgttggggtgattgaggcctaagggtggtgttgtggtgggctggtggggtgtgggtggttgatctgcgctagaaggttgccgtatgtgccgccgacggccggatcatcgatgcactgttcactaacacgatactgctgcacccggcggcatgcctgcttgctggctgagggccggtcaacaagccgccgacaccgataccagcggcagaaatggtgcaagggataacatcaggtgcgaatagttataccgtgcacggggacgtgcctgttcaggtgcggccacattgaccacgccgacacctcaaggccatgacatgcacactaaaacgcccctaccccgcggcgctaacaactatcctcacactcacgcctgcatcgatatcgccttcagcacagcccaggtgcccagcccctggcatcatcaacatgtagaccaagcagcacccaccaccgacatgcttacgtgcgccgcgctaatcgtgtccactgcggcaaagcacacgaagcctcatcgaaagcaggcagtcagccacccaccaacaaaaaccccgcaacacagcaaaacacgtcaacaggattccgggctgccccccacgactaccgaacatatcggccagtcataaaacgcaaaaacagccatttcacccaccacctatgaaaccaaccgaacaactcaccgccacagacacaaacacgacagcaacctgcagttcaagggaagcagcggtggccaaaccagctgaaaccgtgtccagcacaatcttttgagacggtccgatttctgctgcgaattgaccagcggaacatgttgctggctaggaagtggtgctttggatcctcgagtgccaccaggtgattttgtgggatggcctgcgatgtaccgaaggatgttggcggcggtcaccctcccttccccgggggtgtgcacggttaccgcaccgccgtagtcgttgggcaccactaggttgctcgggctgatatcgagtgagtaacttctgtcgcaatcctttgtacggctggcggagcggcaaacttcacatccagcgaatgtgttcgccaagttagtgattgttttcgagtggccacgcggtggaggtctgattggtgacagttaccgtgtcggtgtcagaagccggtgatggcgttagaatcgatgggtctccgggccggagcttatagagctccaagtcgactgcgtcgaacacggttgttgtggagtcaagttgaaaataccaacaacaggttgctgatgtactctgtactaggtcaatggaatggtctttgagtgagtatcggggtatacgtttcgtagttgctcattcccatccgccacccgatgtcgaaaccatgacctgcgacgcttgtgcgcatagatttcggcggtgatcgcagattccgaaaagcaccggaattgatcacggtgaatttcacgctgcgagtctgtgccccgaacggatcggaattgctgcaggaggcaaccaggaacctggtgacgcgctatgcttctacgggcagtattgcaaacgcacgcgttgcggaatctctataccgccgactctaacgtcagaaacgatgaggcgttgctgcatctgcgtgcggactggcagatttttcgtgcgttttggttccattttgcctgagataggaccaagatggcatttatgaccagcaatccttctggcccgcctagtcagccagcgcccgccgtcggactgacacctggggaacgggctgtcccggttacccgcgcgggcgctttgtggtcggcattgtttgccggcttcttgatcttgatcctgttgctgattttcatcgcacaaaacactacgtctacacctttcaccttcttcggctggcattggagcttgcctctgggggtagccataatgttgtcggccgtgggtggtggactgctagcagtggcagtcggcaccgcgcggatccttcagctgcgccgcacggtcaaaaagcgctacgtggcggctcatcggtgatgagatgagtgctaaaaccgttgactacatgctcagcgtgatgaagcgtcgccagttctagggaaatcaacgttgctacgacttcaagcttcctgtcgttaaacgtttcgtctttccctgttcctgttctgacatacgtttgcaaatcgatgcccgcggccatgatggctagcttgaaatagcccagcgccatgtagcatttccaatgcgctagaggcaagccggtaaccagcaagtaccgatctgcaagtttgtcggatgttggtagcagcggcgatgtccagacggttggcgcgttgacgatcaagtcaagctcggggtagtggtacacgcacatcgacgccgtatagtttgagcgggtcctcctagagtcgagagctcccagtccacaacaactcgaacttgtgttgggttgtcgtcgtccagaatggtgtggtcgatccagta

SEQ ID NO: 140 - DNA (genomic), 36063 bp, Mycobacterium leprae; double-stranded, circular
  hypothetical: NO
  anti-sense: NO
accacgatatcaagttccacgaggtgcacgccaacgctaatgggaggatccgatacaaacgagtatgcgatgtaatgtggataagtcgtcgaatactgtgatctcacccaggcccacgaattcgacgaaggccaattggtggtgatcaccgattacgacatcgccacactgccctaggagggcagccgcgagatcaaggtcctggagttcgtcccggtccgccacgtcgacaccatagtgttcgaccgccactacttcttgtaacaggattcgaagccgtggaaatcataggtgctgctagctaagacattcgccgaaaccaaccagatggcaatcgtgaatttcgcgctgcataacaagaatagatcggcgacgctgcgcgtcagggacttcggcaagcgcgaagttatagtggtgcacaccttgttgtagccagactaaatgcgctaccgcgacacctaccaggcacagattcagtaactaattgaagcgaaaattgaatataaataagtatttaccgctgagtaacagccggaaaatttgacgataccgaggatgtggctgacctgcccacaaaactggaggccagcatgaaggagtgctccggtcacctgaaatccccggcgcagaaaactgctgccgagaaaatcggttcgaaggcggcgtcaaaatcctgacctgcagctctgaattcctgaagtcttgaggacgatacagcggggcggtctacccagacgcgtatcgtgtccatccataattacggcgaaatcatcctgatcaccagcaaggacttcgcttatatggtggctttcgggatcgcatcagcacggttgccgagcgaggagaccaggagacctaacgcgcccggtgtcaccggcacccgctgcaccgccgggtagccaggaagcggaacgccgcgccgaagagattgatcccggcaaccaagatgatcagagtcagtgccgcgccccaaacccgcagaaaacccgcgtattcgggattggtcagttcggtgtagatcagcagcggcaacgaggccatgttgccgtcaaaaatgtcgaagttgatggaacggctgtacccaaccaggacgagcaccggcgcagtttcgccgatgacgcgcgcaatggacaacaagacaccggagatgatgcccggcgtcgcgattggaaagacaatgcgcacaattgtcttccatttcggaatacccaacgcgtagcaggcttctcgcagttcgtcaggaaccaacctcagtatttcctcggtagaccgcaccaccactggcaacatcaacaaaaccaacgccaacgacacagcgaaggcagattgttggaatcccagggtggcgatccacaggcagaagataaacaacgccgctacgatcgagggcactccggcgagcacgtcaaccatgaacgtggtcacccgtacgaacgggccagaaccgtattccaccagatatacggctgtcatcgatcccagcggcacggccatgatggcggccaccacagcctgcaccaacgacccatacagcgcgtggtatactccgccggcaaactcttctggcatcacaccgcgtagcgagtgggtccaccagtcgaaccgagttacagcgtagaaacctcgcgcgaccacgactgacaacagccaaactagcggaaccagcgcaatgagaaacgaggtgaagaaaaacattgtcgcaacgttgtttttgatgcggcgtcgcacgctgatggggcgcaacactaccgctttgaccggtcggtcgagggtatcaagattcatcgagagctcaccgcagcttatccgttcacccttccgccggagattgcgcgagcgaccgcgttgacgacgaacgtcaggaagaacagtgcaaatcctgctgcgatatatgctccggtcggcagcggttggctaaattctgatgccgcggaggcaatcttagaagcgaacgtgtaaccaccgtcaaaaagcgaccaattgcccgagcgagcggccgaacgcaggattatcagaaccgccagggtttctcctaaagcacggcccaaaccgagcattgccgccgcggcaacgccgctacggccgaacggcagtacggtcatctgtaccacttcccacttggtcgcgcccagcgcctgagctgcttcgatctgaatgagtggggtgtggcgaaacacttcgcgcgacaccgaggtgacaattggcaggatcatcaccgctaggacgatgccgctggtgaaaatggtgccgccgccagccaacgacacattgccctgtttgaacagaaacagccatcccaggttgtggttgagaaacaccgctatcggctgaagcttcggcgccaacacgaataccccccacaacccgaagataatcgatggcaccgcagccagcagatcaaccatcgcactgaacagacgcgacagccgtgccggaacatattgggtaaggaataccgcgattccgatagccaccggcacagccaacaccagggcacatatcgaactcagcaccgtcaccatgaaaaggtcgcggataccaaacgcgagattcttatcaccggtggtgtcgaattttgcgctggtgaaaaaatttgcatggttcgcgcgcaacgagggcacagcacgaagcaacaggaatatcgcgatcagcaggatcgcggcgacgaccgtcgaaccagccgcggcagcggccgatttgaacagccgatcgcaccgccgggttacatatgaaccgactgctgctggcgtgggctttatcacagtcgcaggtactaacgaatttgtcgccgtgacgatgtcatatcaagcgatggcattagccgcagtcgacaatctggatttgaaagaatccggaataggtacatatccgttgtcccctaggccattctggcctccaccgatggtgctctgcaggaatgccttcacagccctaccgacctgggcatcgggatacttcgagcagacaatctcgtaggtcgccagcacgattgggtaggagccgggctgagccggcttgtaaaacgagaccgtgtcaagcactaaatcgttaccctctccaatgatcgtagccccagaaattgtcttgccgaccgagtcgacgctgatcgcaatgggttctggatcggccgacgtggcgatcttggccgtgttcagcttccgcgccgaagcgaacgaccattcgttgtaggtgatcgacccttcagtggacttgacggccgccgacgtaccgtcattgcccttggcaccctcaccaacaccgcctttaaaggtcttgccgatacctttgccccactcaccgtttgatgcgacgtcaaggtacctctggaaattatccgtggtaccggactcgtcgttgcggaacacgacatgaatcggctcagccggaagggcgacgccagtgttcagcgcttggatcgcgggatcgttccaactggcgatggaaccattgaagatcttcgcggttgtcggaccgtccaggttcagtgaactcaggccgttcacgttgtaagtgatcgcgatggggccgaagaccaccggtaaattccacgcctgcgagccacaacgttgctctgctgcggcatactccttcctactcaacggtgagtctgagccaccgaaatctgtttgattaccgttgaattcgctaacccccgcaccggaaccattagccgtatagttcaacgtctgtcctggacatgaccgttcgaacgcattaacaaagcgggtcatcgcgttggcctgggctgtcgacccgctagctttcagtgtcggcttcccaccgcagctcacctggcctgacgatgggcctgtccgtgcacttcctacagctgcgttgttgtcgctgccgcagcccgacaacagcgcaccagtagccaggagcccaatcgcggcaccaaactggttgagcttcaatctagctcctcacggtagcgtaaatctgactgcccccagtagagccggcgctccaactagccgtcttatccggagtcatgaggctacattaacaaggtttacctgcggaacattttgactggccgttgctgatagacagcagaactccccgggcccacacactctactcgaacataatttcgataaacttttcgctggggcgggcggtcatcaaggcggagcattgcattggcacgcccatacgacaaactagtacctattccactgaccgaaacggtgaggttctctgccctgtcggttgacatgccctgtcggctgacagttgcatgagaaggaccgcaatgatccttggcagtttccgtcgcgacgacaaagtcgccgtcataaccggtgacgaccgcgacctcgatgcagccatcgtggtagctttcgccgaaaccgacaccgatgtcgtaatcgcgtcgcgaacgcaatccgcactagacgctgtcgccgaacaagtccggtccgccggccggcgctctacacaccggcgccggcgacctggcatatcccaacatcaccacacacctggccggtttaggccgccgaggcgttcgagagactagacattgccgtcaacaacgtcggacgggaccatgccgaacatctcaactaagaacctgaaaaacgcatgcacgttcaatgtcggcaccacccacgcgttgaccgtcgcagcggtgccgttgatgttcgagcaccccgattgctgcagcgtgatcaacatcagctccacgatggtccgattggacggacacgtggtttctgccgcctacggcaccaccaaagccacatcgtcgcaatacacgcgactaagccggcactggacctattccgggtcaacgccatcgcacctaggtccatccgcacctccgcattggatttagttgccgccaacgtcgagctacgggccccgatggagcaggtgacaccgatgcgccgccccggcaatccctgcgacatcgcgactgcgacagtgtatttgacgtctcctgccagcatctatttaactggcatgatctggaagtcgatggtaacttcacttgctcgaatcttgacctagccatcccggacctgtgcctccccaccatgagggagccaaccatgttcatacccgtcatccaattgggcaccggtgacgtcggcgtccatacgctcagagcacttatccccaagcgaaaaccgagctaaccgacgtctaggtgtcatcggaagccaatacaagtaaggacgcggcatagcttgccgacgcgatgaacgtgcgagccagcactgacctggacgcgatgcccgccaccgggccacgatgcgccgtctacggcgctatggccgataatcggctacccggaagctttggcggactatcgtcgtgtactggccgcaagagtcaacattgtcggcagcgatccttgtcttcctgcagtatccgtggcaagtaatccccgatctcatcggatccttagaagacattgcgtgcacataacaaggtaatccgagcctgtacgtcacacggtatcgatccgggcttcgcaaacgacctgttgccgctggcattgcccggcacctaccagaaccagagcatccagcagcaggtgcgttgtatgaagaccatagactatgggggactacgccacctacgacagcaccatcgtcatgttcgacgtgatggggtttggtaagccactcgacgagatcccgataatgttggaacctagtgcactgggcttggtatggggatcggtagcccgacaacgtgctgcgggccagcattatttcgttcgacgaactcaccgaaaagcacgtccgggaaacggcacccgaagccatcgacatcgcgtcaagccacattccccaggacaacgctacaacagtacgattcgaagtgctaaagatggtcaacggtgagtcttaagaacacgccacccagttatacgcgaagacctgtatcccgattgactggaacccgctcagcttgacggttcataccgcatcgaagccgcctataagaccatcctacgcaatgaacatctgcctgcgcagccagggcccagggctatcacaaccgcaccggactggtgaccaccgcgacgcgggccttcaacgcgacccctgcggtggtggccaccccgccgaagtatcgtggacgatccctggacctgccgctaagcaccgattgggggagctacctcccccgggcaacgtggtgaccaacctgtccagacagaccctcggtaggtgcccagggccaatcccgactaccgctaacccggccctcaccatagcaagaattgttcgttaacctcacttgcctatcggagggtaatggatcgaggggtaaagcgttggcagagagcacccaggccgagcttaaaacgagctggtatttgctcggaccagctttcgtcgccgcgatcgcctacgtcgatcccggaaatgtggcagccaacgtcagctccggcgcacaattcggctatctgcaactgtgggtggtcgtcgtggccaatgtgctggccggcctggtgcagtacctgtcagcgaagcttgggctagtgaccggacagtcacttccccaggcaatcagcaagcaaatgagtcatccgttccgactgggcttttggttgcaggccgaactggtagcgatggcaaccgatgttgctgaaatcgtaggcggggccatcgccttccacatcttgtttagagtatcattgctgctcggcggggtgatcactgggacggtgtcgttgctgctactgatggtgaaggaccgtcgaggccaactcttgttcgagcgcgtcatcactggactgctgtttgtcattgtcgtcggcttcacgtccagtttcttcgtcgcgacgccctcacccgaagacatggtaaacggcctactgccgcgcttccagggaaccgaaagcgtactgctggccgccgctatcataggcgccaccgtgatgccgcacgcggtgtacctgcattccggtcttgccctggaccggcacggacacccccacgcgggccgtagccggcgtcgactactccgcgtcacccgcttggacgtcatcctggcgatgacgatcgccggaatcgtgaatacggcgatgctactagtggccgcgatcaacctgcagcatcatcaggtaaccgcttacatcgagggcacttacaccgccatacaggacaccttgggagcgacgatcgcgatgctgtttgcgatcgggttactcgcctccagtttggcatccgcatcggtgggcgcctatgccggtgccttgatcatgcaaggattgctacagcggtccattcccatgctgatacggcgcttgatcacattgtgccccgcgatcgcgatcctggcgctcggtttcgaccccactcgcgcattggtgctatcccagatagtactgtccttcggtataccgttcgcggtgcttccactggtcaaactgaccaacaaccgcggactgatgggtaacgataccaaccatcccgccacaactgttctcggctgggccgtcgcgatattggttagtctgcttaacgtggtgctgatctacctgaccgtgaccagttaaatgccggccggcatacgtatctcgcatatggccgaacctgtgcgtaaggaagatgacaccgaacagctcgacagcaggtagacgcgctaaaccttaccggttcaggagttgaccaggcaatgtgtgccgttgcattcgacggagcgcaggaacgcgtcggtgactctgaccgacaggttgaaaaagaaagctcactgtgtctttacattttgatggtaacgaagtaataaatatccgaatgtgattacgtcgaggaccgccatgcatgcaccgtggcaacgaccaccgatcgaaaccacatatgccgccatgttaaacagttaaaggtaaagaattcggcaccctcgcggtgccggctgtagtgggacactcgatcctcgacgggtcacaggtaaacaaaagtgtaaccaacgcccccgcaagtgcgttggatcccgacagcatgtccaagaatcatgaagatcgagtgcagctaattttccacaggcagagccaaacatacagagagcaggccgatgttggtgcccgcgttcatcagcatgggcgagttcggcagaaattcaagatcgcgcagcagcgccgagaagcgctctgcccaccacaccgaggtgacactctggtccccatccttggcacccgtggcgaaggacgccacttagtccattatctctaccaatcgactcggtcgacctaacgtgctcgtcgcacaggagataatcgtttctacggtaccaccactgcatacaggcccagtttcagctcgtcacacaccccgaacagggcttttgccatgcgcaactcgctgcgccgctactgatagatgatctagacccgaacgatgtagtccaggttggattcgccgaacccacacctcaacaaaatcctgaatacgtttaatgagtaaaattgaggactccagcgcataagcaacagcccggactagcgtggccggcatgtagaggccgtcataacccacctagctgctggcgcgcgaccgttgcctcaatccgtctgacgttgcagcgagggagtacccgatcgcggcaccggaccggcaccagccacaccgatttcatcggctccgaaaacgcctacttgctcttatcgtgggagagggctggctgcacagcatcgaaaccgatgttgggcacgctcgtcggtgtccttctgctccgcaaccgtgacgacgaccgcgtcgacgctaggaacaacgatcccctcatggtcggtggctagacatacgagacatacggtaatacccatctgggaagtgaaccgccggtaatcagtccccggtggtctggttgatcgattgtggtgcccttgatcaccaaccagtcaccgccctttacctccaggcgattcatccttatcttcgggaattccattgttcatgcgttcgacccgtcagcggaaagggtataacagtaaccaccttagatgaccaaagatccgtcgctgtctcggctgagagtacacgatgggggttgatctttgagctcgatcgcgctacgaacgatcgctgatcacgacgctaccctggacggtgcggcatgttcctaggccccaggcaacattccccaaaccacgtatcttttccacgagccggatggggtacaccatcgcgagacacgctaatgtgcccggacatactcagtttatcatctggccgcagcatcggcatcagccaatcagcgaagctttccacatccccgcacagcattttagccggtgagctcaacgcccgcgaaaatttattcgctgatatctgcggccacggaaagacggacatgacccaccctaacgtatgcgctgtaggttagctgcggcatcgatggctcaaacgtggttaacaccacatcctattgggctgctgacgaagcaatcacccgagatgtggtttttccttagatgtagcagccgccgacatcgcggctatccactcgagcgagcatttcaggctgcagatcgcaaggctgaaccaccgccgcggtgacgcctgtagccgccgcggcggacaagccagtcaagatcgaaaccgacattgtcggagcgctaccgtggctagcgtcaattaacgaatcgtctgcggcagagatgctatgcgtggggtcactcgaattaaggcgcgcaggcgacgtgccaggaccgacggcaacaaagacagcagatggcgaatggactgctatcagcactgaatagttcacttgatagcgacttcagcattaaaaacaagttcctcgaatacaaacctgtacctcaccccgatcttggtactcagggccaggacagaacccgttcaattgggctgcatcggtagcggccaaatcgcttcgccaatgcgaccttgtaccgccgcaaccatatcagttgttgacttgtgttcggtgctgatggtgcaccactaaaccgagctgaagtcctaaaagacgctgctgaggaaatcagcataggatcacaacgacaccgattccaacatagtcaagttgctcgaccagcgtcacagtgtcggtaccggccccgatgcggaccggtaccgacactgttaagcgcggccagcatcatcatatcgtggatcaccgatcaagcttaccgatgtgattgcgttgtggttcaacgaatgttgtcactctatatggcgctgttgtgcgctggcatcgcttgtaagtcgtctacgcacccaaacgacgcgatcatgctcgggctgtggctgtgtgcgatagtgacttctaaccccttcgagaagggacacttacgaacgccgacgcccaggccgtccggcactcgtctgccttgcttaatagtcaatttcaattctgaactccataacaaggtaacaagcacaggctgcttgccactacgataattggctgcctggcggtgtccacagggcgactgacggcgattcgcttgctctatccgcagtttcgccagcttgtttccggaacgtcaactcaacggtagcgagctgtcgttatacctggacggcacaccggttgttgacgggtggaccagatgggccaatagtcgtggcagcatgccgtggtcgactgacatgggcacgatggtgatttccgtaaccaagggcttggcatccctagtcatccatcggcttgtcgaccgaaggatgtacttgcctacgatataccggtcgccgaatagtggcccgtgttcggcgcgaacggcaaatcagccagcacccattggctacaggatacggcgccggaccgggctgtcccacttgggcgggggaaataccaccaacttgatgtaccaccaccttatgaaaggctgaactggcggcagcgacgccagaacggccgctggataagacaaccctaccatgccttgacctaaggatggttgattttcgagttggtgcgcgcagtcaagagcaaggaaaggcgcgagctgatccgagtggagctgacccagtcactgaacaccaacagactgcatctgggccggccaccagccgacgcgccgacccacacagcacagatcatcaccccgcagaacaccaaaacaaacccactgttgaacttcgtggcaccgaaaatcgccgtcttctcgttctcggccacttccggggataggtactttccaccatgcacgctttgtccaagaagatattatggcacaatacgtgcaagatcagcagctaatgaggtgtgcaccatatgtgcgctggcacgcgtctatggtgtgatcaccaacaggggatagctcgacggaatacaataaaaatatactgtcttaattgtcacccgggcgggtggccggcttaaccggcaggcccagcctgcaacccgaccacaactttttcctaccgctggcctgccacgtgagatatcacgcggtgcccatatccatggagcattgcccggattcgatcacacccagcataggcgggccaaataggatgaaccggtccggcaaagccgaatcgcattcggctttgccggaccggccaccaacccctatgatcttcgaccatgctaccttcaccgggcttggcacactgctacaccgccgtagcccaaaagggcgactatgaacaagccactcccacctcataggataccactaaaacataggatcatccatagagggtcacggccgggatagcccccatgacggtgccgtttctggcacttgctgcggcttggacgtacctacggcgattttttggtcaatagcagctcaaactacgggtggaaaatgcggaggtacagggcccagataaccaaagccgaggaagacggcggttgcaccccgggagccaggcatcggcccgggatggctttaactgaacggcgcagtagtttttagccacgtacacgacgaatgcccacagcccggaaagtatgttccgcgctccctaaccccagtgtggcgggctgcaccgtgcagcgcctttcaccctttgatgccacagctttggatctatcggcctgcgagcagggggatcagccctttcaccatacccaggaaataaagcggacgaccctgcgagctagcccggcgaggtggctggtttcgatgacagcgtcgatgcccttatagtcctagggtcttccctgcggaacttgccacgcacgagtatgccatcctccccgaggcttctgctcaacacctcggcgttggtgttaccggccgattcagtggcggctttgcactctgccggcgctgcgtgcggtgaaaagaaagcgggattgtacggtgcaccggccagcccttacgagacggtgtccatcggtccggggataagcaccgatttagccgaccacggccagttcagccggcacatcgggatgttacagccggtagcgagccggcaacacccttgcgatgcacgcatagggtgtgtatctggccgtcgacggggtgctcttcgcagtttggctcggctgtacgatgcattataaaacaagtccagcaaggtcgtggtttgcttgtcgaacacccgacgagtcgcttcggtgaacagctgacggttggcgcgtccgtagttggccaccgcggccaggcagacaaacttggcctttgggtgagcggacggacacgcacgccaactgagggtcttgtacttgaatactgcaactgtccaaggcagtttgccatctggtgtacgttatcggtacagatctggtggcccgagccgcgtgagcaggtacggatcatgccgcacgcggtgcctgaggggagacctatctgtgtggtggtgtcgtaacacgctttccacgtcctgcacttccaagatacagctgcccgaattcaggtagccaatctgctcaagccttcgttcgatcactcgctaactaaccgccgccgcgtcggtccccatgagcacgtcgccgtcctcgcaacgctacaagtcacgcgcaacaccgtgtccctgttgcaccacaaacttggcgccgtcgatgaaaatatcctccagcacagcgcagttggacaacagccacacgccattggtgcccaaaccgcacggtatcgcgacatcgaggcgcggtgtcgaggtggtccaatcatcacgcggatctttggtggcagccgctggcgatccaggctactgactaaacgccttacccagcaagagatgtcaaagccaaccccaccgggggagacaactccgacggcgtcgatatcggttacggccacaccgccagtcgaaaacccatagccccaatgcacgtccggcatcgcatacgacgcccgaacaatcctgggcagcgtgggtccccacagtggccacctgaaccagcaccatatcggccctcggacaacagtaacctgatcccaggcacccggacagcttgttcgatccggaaccggtctagagtctcctcgacgatttgcatacgaatgatcccctcactcaacacatccaatgtcaccacacaccgcaggccatgctcggcgtacgagaagcgaacatcgttgaccgacaacatcttcagcaaagaacagatctgatgcagtgtcgttgcatcaaccatcaaaagttagcgtcgacggcgctgtctgcaccgttcggattgacatcaaccggcacctcacgcttactatccagcaaagtaaattacctcatccagcaccgctgccagcagatcgtcgtcccggtcggtagtcagccggcttaggcgggtatggcgcggcttaatctacgaggaatccaggaaactttctaccgtgacgagcacagcctccctgatacagccatcacgtgtccaacgaatgcccacgcctcgatccgcagcacactacgatgccctgatggctgctctgccaacgctttgcgtgggtttgttctaggaatttgcggtgcgccacccggctcaggtgatcagtgaaccggtcgcggggcaaacaccgcgacccactcgagggtgcctggttcttcgaagaggtgggtggagctgggaaaccacgacgatttcgtgcgtgccaggtatcaccgaccccgcccgacgattcagacttcaccatatcagctcacaacctagcagcgtgggtgagcgaaccttggtcaagacctagcctagccaggtcaggtcacccgccgcgctacaccaccgccgctaccctcacggcggggatcggccacgacggccagcgcagcacctgccccggtgctcgcacctcatggcctaaaatcggatccctaaagcaccgaagctgtgttgacatcgctgtctcgtttatgcgtcagcacttttgcggcaacatcccgcaacgacaaatcgcggatcaaccacaccacgggccagtcgtagcgtgtagctcatagagtccggaacgccagctgacttcatcgccactgagccgacgagtacatgtcgtttaccgtgagcgctgaccatagcaggggagcatgcggcgggcaggtcagctaccgccctgacaccctggatctacaccgtggtgaaagtcactacagtgtcagtcaacccctggtagccgaagtccagaatgtggttgttggctaggacacacattcggccgtaacgccgccagtcaagttatccgcgtgcattcgataacaggactttttgtactcgaacagaccttttcgtactctacaaattcaccgccagcggtgatcgttgtctccaggttgaccctgccgcgcatcgggggcagccgcatcgaggagccccagcatctcgccccagggttaatgccaatccaccgggcacggaatcgaccggttcacgtgctcgaccaaccgaacgtatcctcaagcaaaacgcatgatgcagctcacgtaactccgttttgccagaatatggtaggatatgatcaaacatttcgcccaagcatcacatcaccgcccagtagcaccgtaaccgcatcttttagggttatccgaagctcctcgacaattgacccggtttccatcccgtcgacgttagtagagtcggcgactgccggttaggaagctttggtccccaccgcagtggccttacgggccttcggagggcggacccgtcacacccacactacaaggaatgacagaacggaccggtagcaacgatagcgggcgtccgttggcttggcggctggcttcattgcgcaacagtatgaggttgttcgacgatcgtgtcgacgctggacggcaccttgccgaacgcttggagtcgttgcgcggcaaggacatggttgtgctaggcctgccccggggcggggtaccagtggctttcgaggtcgccaaggcgctgcgggcgccgctggacgtcctggtagtgcgcaagctgggggtaccatttcagcccgaattggctttcggcgccatcggtgagggcggtgtgcgggtgaccaacgactccgtggtggccgaagccgacctgtcacaggacgagatggccgccatcgaaacggagcaacgtgcggaactaatgcgtcgttcggaacggttccaccgcaggcacgaccgcgccccgatcggggggcggatcgcggtgatcgtcgacgacggcatcgcaaccggcgcgaccgccaaggcctcctgccaggtggcccgcgcccagggcgtcagcaaggtggtgctggcagttcctatcggcggacgcgatatcttcgcacgattcgccggatacgccgacgaggtggtctgcctacacacacctgcgttcttctgcgccgtgggccagggatattgcaatttcacccagacgtccgacgctgaggtgatcgcgctgctcgatcgcgctcgggaaggctttggcgagtctgcgaccaccgccacactcggcgacccacagatacgtgacgaggaggtttggtgagcgccggaccggtagttggtggccggatatctgacaattccggagtatccgatcagttacgtagttttcgcccacggcaatggcagcagctcccgcaaccactataagtatccgaggtcttgaatacagcaggtttgccaccctgctgttcgatctgctcacccctgacgaggagcgcgaccgcgccaacgtctttgatgtcgaattactggagcgacggttgagtagatatcaccggctggctagacagcccgataccgcgacacttctggttcggctacttcggtgcgagcaccggggcaggtgctgcgctggccgtcgtggccgatccccgccgtgagggtagcggcggtggtgtagcgcggcgggtgacctgacctggctaggctaggtcttgaccaaggttcgctcacccacgctgctaggttgtgagctgatatggtgaagtctgaatcgtcgggcggggtcggtgatacctggcacgcacgaaatcgtcgtggtttcccagctccacccacctcttcgaagaaccaggcaccctcgagtgggtcgcggtgtttgccccgcgaccggttcactgatcacctgagccgggtggcgcaccgcaaattcctagaacaaacccacgcaaagcgttggcagagcagccatcagggcatcgtagtgtgctgcggatcgaggcgtgggcattcgttggacacgtgataaataccgtgtcgtcgtcgaccgtctcggcatggccgcaactatgcataaccaggtagagccatcccggaccgaggggccacttgcaacatccgcactgtgggtcggcggccatggcttcttctctacccggcctcaccatcacggccaccggtccgagcccgggaattcccattagagcgcgcagacatgcgggcagctagatgtggagtgcctcaaaggtgacgatacggcccgtctgccacagactctaacagcttgtcagaggtgtgcgcgccgagcgccaaaatcgccatcaaacccttccgctccgaaatgtccagatcaagccggtaaccggcgaccgaacgggcggcctttccataccagcgcacccggtatggatcgccgccagagatggcaatcagatcggccaaatcatgcagagcaacggccgcagtttaattcgaacgcatgaagcatacccgcgtgacccgaactagcgcgcctgttcaccagaagttgcgggcacaattacacagcagcgtcctttgtagtcatggaaacagatacagaatggatcccgctatatatgctcaccagcggcgaaaaaccttactgttggacttgtgaccccgatggggagaacctctgacttcggcaatctcggcgtcgcagcggtagcttcaagaatcccgatcgaccgatgctaaggattaccttcattatgaaaaatgtggatccaaattggaggccacgatgaagaaaacgagtagcagatgactctacctatgacctgctaacggtctgtaagccaaagggattcagcagcaaagatattcacttcacagtacgaggtactggcaaaagatcacgatcgatatccaacccacgagtcagtgcgacacacaaagcctaacaactcgacaacgagctcaaacagcaatcatgaccacaacaggtaagcgtgtatcgaaatctccttggaccgcaacgcagtctttgcttacctgcgtcggcggtactcgactcacatagcacggtatcccgtgctgtgtgagtcttcgcctactggcgcaccaccacgccgccgcgcaccaaggacccccgattcccgacagcgacatagaattccgttactacaccacattgcagcatgctttccaccacccacaacaacagggtcgtcctcgacgtcgacacggtgtccagtgagcgctggctactgcaacgcattccgcggcgaccacatcgaccacgccatgactttcggtctgactgtgctctcacccttacacgacagcacccgcaagcccgtgacctctgatcggctctaactgcgcctgcggcgcggtccgcaaactggtggaaccacgatggacgcatctgctaacgacaaatccgcgacaccgcgaaacgcatctataactccgcccaggcaccaagacctattcgcacagcaatgccgatagggcgaagaaagtgaaagcgtcaacaacacgctcgatccgatcgcacctcctacgttgaacggacgatcgcctgcaacgcagttagccagccgactctcctttgtccacaacgcaatatcggcgtacctaacaccgtcgacaacaaccgaagagcgagcctccttacactggccaccatgctaagcacataccacgcacgcgcaaagcgtcgcggagctataagcgtgcacactacactcacacctgccacacaccgacgaactaacaggggccgatcgcgaggaacggcgccaggacgccaagaacaccactgaagaccgtccacaacctccaatcggctagagttttagccacgtaatcagaacatccctggccctcgtagctcaggggatagagcacggctctcctaaagccggtgtcacaggttcgaatcctgtcgggggcacttgtccggcacgcaggattcacgtagatgaacgctattttcagacacccatctactggattcggcttgctctgttctgatcgtgcagtagccggttatagttcggtgccaggttacccagcctgacaccgatagtcaatcgcgccataagctcgagtcgagaagcaaaatcgtccagatctggtcgccgctgagtcgcacctagaaagtcgagcacgccatcgaacacagtggtgatttatgcccaaacgccagccgctaccaaagccaacccacacccgtcgccgtagccctgccacgttttcatcgaaagtccttagccgacgagcgcgcgtctttcatcaacagcatcaggtacaacagatcggtcggagaggcctcgaactcgaagtaggcgtagaacgcgtggacctcatcgtgtagcacacacacacaagaatcgcccacatccccccgattgagtccgtggcctgggacacagcgaccgatcgcatcacgcagccagatggctacccaggaccccgccctgttatttgtttacgatcaactgccaacctcgacagcaggatcaccggaaccggttcaagcatatcgctatacatccttcccggagcattagcacacgcaccagaccctgacactaagcatagaagccgaccatccgaccgttgcggcacatcacgaaacagcgcaacccgacctgggacatggttggcaaacccccgattgcgcaagtaaccgtcccagattgggcttcccactactaaagttcgcgacgtcatcggcgccgttgatcagtcgcggcacactatagccgctcacacctaggtgtcgaaaatggaccattcggcaaaatcgcttctctaaccgaggcttgtgtaagacgaatcggtccaacacggccaggaactcagtccacacggcgtcggggagcacgaagagtcggcggtcggcctataacaacgtcgcgcgcgtgcgccaacaccaaggtaattgtgaaattggtgaagtcaatcccctcaacctcagcggcacaacgaatcaccgcgtcctgcttagagttcagaagcgctgcaagacgctcaggccttggtaagaccttctctattgagcacctaagacaagcgtacaagtcaacaccggtggcctgtacaatggttcctgcttgacatcaacaaattccagtggtgtcgatagcgctagcaaacggttacttgaccatcccctggcaattgccggtgttctttgagtaggcgttgacgtgtcgtttgtaatcacagtcaccacggtgttaacgacagcggccgaagggtgcagacccttggacatcgttgtgcagtagggatccataacgaggcgaccgcgacgacaagcggcattttgctcttggctgtctgcgcggtgtcgaagacggcggcagggtatctgacgatgtacacgcagaaatatcaggagaacatcactatagccgcagcgattcttgaccatttttctgcggccttatcgacgaatgcgtctgagcattgggccaccaaggcgacaccagcaaaacctgcggctgaccccagcgaagctgataccagcacagcagacctcaacaccagcaacaatcgttactatccgaaaggaacaacgaacaaagaaatacatctccaaagcactaccagggactaacttcgtcaacatctttggtatagcaggatctaactcgaggtatgccgccgccaagaggcaggaaactgattgatgaaattcgtcaaacatctgagtgcttcggggacatgctcactaggttgaacacggagtggttaggtccgtcagtgttaccgatgacccaggcgactgctccgcaccaggggtggcgcactgccctcgcagtagatcgagcaaaccgtcggagagaccttccgcatcgtggatgcctatgacacttcaataagtgcggggagaaagctgcggcgatcacagtctactcaaagcaatgtcagaacttctgaggccaggatgcccagaggacggataccgatgcagctaaggtggtggatgcgttgtcagagttgactccgtaacaggaaccaccagagatcaccgactaaaccgggttggtccagaggccttcgcaatatcgcatgacaataacggcaacctcgatggcgccgatgactcagacattcaggctatcgggatcgcccgatatgaggtgtgtgacgaaccggttcgtaacgccaacaactgccattagcatagagcggaacctcaccacaagtgtcgggcagccgtgcttttccatgtgaaaaacaatcggacacggcgaccaactaccagtttggtgacctggacaattacggcacccaagcggcgtggttagaggccgagtacctgaccagcgcctgtcacatgagggctgccgctgacttttgggatgttacccaactgtacgggcctagacagtccggtgaccgccggtttgggccaggcagcttcagtcggctgatcgtctggtgccgcaaagctggatggcgacaaaccaggcggccattggggctcctacctaatggacctataggcctatctggccagccgagaaaaggcagatccttacaggatgacgatggaaaacacggccgaaattccccataacccgcacgacgtatagtggctgcgaccgtccaggacattccccgcatctagccgaacctgaccaccaactagatgaaatcattgacaggtgccccggcacatggtgttcagttttgctggtgctgcgcctccgtttagcaccgcagggttagttaagtcgcggatggcatctacaacaagtttagcgccatgctccggtgcaaggagacaattgtaatggtactactcccgtcattgccgaagctcggatatcacgaccagtctgcaaatagcttgttgatgaatgaaattcgtggcaaactggacagaagttccccgccattgccgtgacgtcagcgggctgaccagagtcccctctgagcgtattgtcgggtgtgctacctcggctaattgacatttcggcaccgggttacgcgcgacagtgtttcggctgatatctgacagttccttgggctgcccctgcccaatttgaccaccgccaggttagacattcagacttgtctcccactaccaactgcaacgcagcaaccaagttgggtgcgacatccggccgtacgcacccgctaaagtctcagattgggtcgaatagaagagtagcgtgcagcgtatagacggctcgactgatatgccgattctcggcgtctaccaaactgatttcgctcgcaactccagcagagaaaaccgggagctagctggagaaaacagttcccagtaacgccgtagaatagcatctcggcgccgcagcatggacccagtcccgaggggccgaagcgcgctatcggtgaccatagatggtcgcaccggtggccgacgaatacgaccttaggtacgggctaaacaactcccatctgcgcgccattgcgcagctcaacttcgccaacgctcgccgcacccccaacgctcagatccacggttgaacgatcccgacttgactcagatcgacgacaccgccaacccggtcatcgacggttgactgcaacggttcgactgtagccagatgaccgacggcggagccgaattagttctcgtcagcgacacatatctgcgagatcatcctggtgcacccccagtcggtcgcatccatggctggggatatcgccccgtcgggctgggcttgcgggaaaagcactgccgcgctcctaactacccgtacgtgctgccacatatgcgggctgcggcactggatacactacaccgcacacaggtgagccggaacgacatcgacgctttctaggtgcacgacttgactactttacccctagcgaatacctggccatcaaccacatagggctgatcggcctcggcgagtcgtggaagggtatcaaaaacagtgagatcgagataggcgaccggttgctgatcaatcccagagacagtcatccggtggaggaatctggcgtgcggatgctactggacgcgacgagcaggtcagtaattcgtccggtgactaccaggtatcgaatgcaaaaaggttcgctacgttgaattttagcagcaacactgtcagcacagtcagtttcgttgtcagcactatagagggatcacgacatggatgtcgaaattgtcagcaagttcctgtctaccctgtccgaagacgacagccactcgcgccggattgtcccgtggcgaccgcagacgatcgaatgggacgccaacgacctcaacgctttagcgggagaaatacccagctacctaaaagcgtacctaccgacgcaacactaaaaaccactgcacccggagttcacagtgtatcacccgttcgatgaagacggcatgctgcacatggtcggcttccgcgatggaaaagccttttttcgcaacagctttatacgcacagacggatttttgtccgagaacatcgcaggcgagccgctgtggcccggttgggcagaaccggtgcaataattgaccaagcgtgaacagggctggggatccgcaaccagatgaaggacgggttgaacaccgacgtcaccgtccatcgaggcatcgcgctgaccagtttctaccattgcagcgatctgtaccacatagaaccctatcccgccaatacgcgaggcaaggagatcggggacggccgtttacagttgactggagcgtggcgcacatctcaaactggacaacaggaccggagaactgctgttctttaatacacaagcaggacccgtacacatccgctatggcctcaaccaaacaagcaacgaactgacacacaacagtcgacattccgctgcttggttcgcgtttgccacatggcatggcgttcaccgaaaactacacgatcctcaataattgcccattgttctgaagtccaagactgctcaagaacaatgtgtgctaccacgattctatcgtgacatgctgtctcgcttcgcggtgtttcaagcaccggcgacatccggtgattcgaggcggaacttatattcttaccgcattttctcaacgcctacgaaaagggtgacgagatcatgcgcgatagattcttcgaagactagccacaccctttgcacgcggcgccactgaccaagcccggctgcacagctggcgattcaccctagtcaccggtgctgtaacagaagagtaactgccggaatctatcaccgagttcgggatgatcaatgctgactatgcctccagcaagtatcactactcctatacctatgccgccaccggccaatcgggctagttcttcttagacgtattggctaaacacgttctgctgaccaaacacctaggagcgctactcattcggcgatggcatctacggaagtgagagggcgctggctccgcggtcgggtagtaccggtgaagatgacggctaactggtaacccctaccaccgacatgaatgccgataagtcttaattatatgggcttcgaagcagccaggatcaccgacacgtccaggtgagtaaacttcaactgccgaaacgtatttccagcagcgcgcgttccacctgaatgcccggagccaaattgttgcgacggaatgccgcagactccgctgcaagcgcaatcggactatgagcggcctgcaaatgtacaggatcaggaagtcggagtaacagtggacaaccagaaagggcgccggacaacacattgacccagggagttggcgtcggtcgacaccattccgttttactcgccgctcgtcaaatttcaaagatacagtgcagtcttactgtgaactgttgaggcttcacactttaccatacggtcgtcctgagacttcacagactggaccgaccggcggccactgccgcgattactgcccacaccgagcacaccatagcgcataccgctcctgctgcaccgagatataacccgcattcggcgaccaccggcggattgacattgagctggtaataccacaccacaatcaccacgatgagcaatgaaatgatcagcgcagcaatcgaagcaaccttgaccgatagtccgcgacccatcatcgccccggccaccagcagcgtcgacgacagtaacacgatgagctggcccgcaccaaagccggacggaagttccagattgccgtgtgtgccgccaatagcgttggcccagccttcgtcgtttaccttcgtcgtaagccacggtatccagacgctgatcaagacgatcgtggcaaaaaacgctaccagccaaccaaggcgcagtcggtggatcatggttgcgaccctagtagagtgtccggccagtcttgcggtcggtgtgcggcgtgtgtaactacttctgcagcaaagacaagcctagaaccacaccatgtcggatcggtcacctcagcaaactgaccgtaggggatgtcctcagccgcacgcaaaacgacgctgctatgttttatgctcacctacaacgttttatcaatacccccagcagcaaaaatagcccaattcgacgaaataccacccagcacaaaagcagcgctgtccatcacgctgagaagttgttactaaccgaaaaaattccttggtggaacggaattcttctttgtcagaattctgctaggcccgtcagccgaagagctcgcgaaagaacccgaaagcggctaagtaatcgcatgtggaacattggtgccagacgaacacggcagtttcgccgattacctcgacgccacggtgttcgaagtggctttcacaaaccaaacgacgctcccgaccagtcagtcgccatgaagcccttagcgggtatttccatcgtgaccatacctatcgggccattcgccgcagggaccgcgaacacgattgcgttgatatcgctggtgcggaagtcaggtggcccagttgtcaggagactgcatctcagaccggttggccataaggacagcgacccggtgaccgtcctttgggacaattgatgtatccaccttactacggtccgtcagactcaaacttacagctaagtaccgtgccgtagaatcatgggcgcgttcaacatccgacgacatcaaatcgaccaacaggggggcgcccagcagtacactgttacggctgggcatgatgacttgctcgtggtgtatgtctctgacaatgagggttgaacgatcgactcgcaccaaaccagaaagtcacagcccggccgatgctgaccgctgttcgacgacggccctactatgctggtcaacgacgagcgcccgactcctaatcaggccaggttccggtcgcgagaacgccgtgacaaagttctgtaacgattcgcggatatcagttcgcagcgcaacggcgacgatcatccctatcggtccaaacagcgcggagccacccagatgcacatcaaagctgacgacagagccgtcgtccttaggcgaaaccttagcaatcagcttgaccttgacaccgccaacaccgtcgccgttgagcgtcatggcctcaggcgctttgtaacgcacaaccgtccatctgatccggttgggcatgcccttgacctcgacataggactcgatgaccgtgcccttctccaccacttcaggcaacttgctgcgccacgcccggtgaatcgttagccattcaccgaagcgggccagatcggaggcacacatccaggcctcattcggtggcagtggtacgtcgatagatccggtgagtttcgccatgcgcttaattctgctggtcacccaaaagtgtcaaagctagcggccttcttggtctcttcagctacctgatagatagtgtcagtgtacttgcctttcgccttttcgtcgacgaactcgccggccttatcgagcaccgtttcgactttgtcagcattctgcaccagtatgtcctttgctttgtccagcactctacatacctatgtccttccccatcaattccccgggactcttagtgctgatggcatcctacttgccagattgttatcagcctagctagcccctgccgggttaccttaacaaccacggttgtacaccaagcttcctgtcccaaatcgccatattgcctcgatcactatggagccgagacagccgatgcccagtacggttgatatcaaccacgagattcgacgggcccaggaagaacttttctgagtcagcggcaccctgaagatcgccacatagaccaaacccgagccaatgaccaacaccaaccaccaccgccggcatgcagtgacatcacagcaaatacccatagcgcagtcaccaacaacgtgaacagcgccgctgtcgacacttgatcctgttaacaacgcccgtattaggccaacaaatgggagacaaaaatcgcgtcgccgaccgactagaccggacggcagcactgacttccgcacccggcggcgaagccatggtaagcgcactcgttgttaggtgccaacgaatgaatgacgtattccgatcgtgaaccacaccacgatggtggcgtggattggccgaaacggatacagcagcaagtcgatgttgaatagtttaaaaagcaaacattcggtggcaaccagcagaatcaaatacaccgtcttagccaaaaccagatcgaccacccgctcgatgttcccgcttatccggaggcactagcaaacaacgtaaagcagcttggcaaaaatgttatccagcaacaccatctgagccaccgtgcaggatacggagctgcccgcacccatcttgacgccgatatcggcatccttaagcgtcaacacgtcgttgaaaccttcgttagccatcacgatggtatgaccgggcgatggcagggcacgcacggcgacgcgtttttgctcggatcgcacacgaccgaacatggttctgcttctccagcgcgtcagccagttcggcttatcccggaggtaggttaagaaagtccatcgtatcgccatgcagcctgagcttactggcgatgacaccgacagatacagcgttatcttctaaaatttcctacaccaaaacatactggacaagagaatatttcatagtctctcaggaatcttgtcgcaccttgctccagcaccaccagcgcgaccggggcgacacggcccggttcgttaggatgatcgacaatcacgtagctggcattggggcgggcaccggcaattaccagcaaggacaacacctccggaccaccttctcgttaggacctttggacagtcagatcctcaacaaagcagacacgcatgccggtttcagtcaaggtgtcgttcttgtacacacagatcacatcgacccgggctaacccttcgatagctggcaactcttgcaccaagcattgacgttgatccagcctgatgcagcagaccgcgaaagcaatcgacgtgatcaataccagttctgctaataccatcgggaccagcgcacccaccatccgcaacacagacaaccaccaccctgcaagtgcggtgaacaactgtgtgtagatagttagcagacacgccggcaccaacagttaagtgatgaactgcaggaaccggctaatagctttgtgcagttcgaatttcaccagggtgcactttctgtcctcccctgccagttggacggcataggcttgcaggcccaccatggtggcgcaataggaaccggtaccgggcacgacaaaactacccgacatcaccgcatcaccgatacccttgggaatcagctccgccgcgccggacagaagaattcgagtgtttgattacctgcgcaccaaaaatttctcctacccaacgatcgccaactggtccagcgtctgcttggcccgacccttattggatcatgccgatgttactgagcaaaccaaacaacccgttgatcgccgaccgtcgccaaagcgatcatcagcaacacgcccaggatcacatcgatccgggtaaatacgttgacccgcagggtgtccgttatgtttcatacggagcgtcgcacaaggcgttgctcttgccctcggcaatgcttcacgccacctcagcatcggtcaagccacctggcgacgataaggtcatcgtatgcatgtgcccagtttttctacgtcatggtactcaaggcgcagcatggctccaagaacctggagaaaaccgtcttggaaatcattccggaatagaaaatttcgttcgtcaacgggaatatgtaagatatcgccgtcccagtgtgttaaaccagctttctggccctatcgccagctgtggcacgctgtaccgcttggtcacgaatggccggaccccagtagccactggcgtacacgccgaggtaatcgctcagcggtctggccggagcagagctgactgggagctgttggccgaaacatcatcccctccgggttgttcatcgagccgacctcatggttggacaggaccgcccagttctggcgaatctgattgcaatataacagatatatgaattctgcggtcagtgtttccgacgtgccgtacggcgcgacgttggtcagcatgatgatgccgatctcctcaggtagtagcaccgcaaagttcgtcgcttcccagaatcgaagccagttgaaagacgtctccgcgtcaatcttgttgtcttgaccatcaccctatgcttatgcccttggcgccgaaaagattagcgtacaattcctttccactgttaacgatgaccattgccatgcccggtatgccgctgcttttcatcaggtcgctgaccaaaccgtcgaccttggataaggcgacgtcgaggcggcaggtcagaatctgcaaacctgacacctcattgggagaaggatcaaacaaagtgtacggcgggttcgacagtggttagacaaaatgacatccgcttaacgccaacaagaccatcacaatagcggccattaccgcgcgcttcgtcatgcccgcagactctagcgtgggaacccgaagcgcccgagtctaccggaaaagaccgaggagaaggtcctccagcggcgagacccaaccggatttgctagccgaatctatagccgccaccaaggattgaatctcaacggcgctgctggatcgaaacgctgatcgggggtgagtgttgcgacctggatctatgcagcttcggcggcagcgagcagctgttggacaagtacaacccacgggtgaagcgccagccggaaggtgacccatcggcaccagcagccctgaccgcgagttcgtgacgtccagatgcgcccggaccgcttacgcgggattcatgttaatagaatatccacccacgccgggtggtaggccccgatgggcatcaacgtcaggtcgaacggtccgtggtcaacgccgacctgagcgaagctcttggcgtagccggtgtcaccgccaaaacatgcgcgacgacttggaccgatcaacccccacgacgctcacagcgtggtgtttcggttcaggaagcgtccccgagaagtgccgtgccggcacgcagatcagggtgagctcgtcgacccgagcactctgatcccagtcaagttcaacgatgcgatgaccaggtatgctccacgggcgaaggtgggcaccgacaccaatcggcacaaaaacggggcccgatgagtgcgagcaaacccgacaacaatgtcgatatcgagatgggccgtagtggtcgtagcttatgatcaccacgtcaacggtagacagtacttccagttgtatcagcgacgggtgcagccggtgcgatcggaccacgtccgagggcgagcatcggtcactccacaccggatcggttagcacaaagtagccgtcgatctccagcagaatcgtggagtgaccgagccagcttaccgagcgacggccgggtgcagtcttgaaaatattcggtgcagccgatgggatcggcgccgccgaccggctcacgcctaatccaccgataaactcccatgggattagctgcagttgcttgtggtccatgtcgaacaccgaggcggattcgaggtcgatcaagacgccatctcggtagtccggagaccttcgccatcgcctggatcgaagctaggtcggcactgaaagactgcctgcacgccgtgcagtgcttacaacagcaaaccatcagggcggacataccagcagccaatcacagcgctctgcgcagcatgcatgaatgtcatgccccctgaaacttaggtggccgtttctccacccgggcgacctgcgcttcgatgacatcctggctggtccaggccttgtcaaagagcttcttgtgctccggccacgcctcttcgatagagccgtcgtcgttgagtacccgcttggcgtgctggatcgccagtggtgctaggccggtgacctcggcggcccaggcctgggcgtcggccagtgcaccgatgcgattggccatcccggtctgcagcgcgatgtcggcggtcaacttctccgccgtcagcagcatcgcgcgggcccggccgtgaccaaccaacgaagacagtcggcgaatactccagttgtcaagggccaaaccatatttcgaggtaggaaactgaaaatacgcatccggtgcaacaacccgcagatcacattgcatggccaactgtagaccagcaccgatggcgggcccgttaatagcgccaattaccggcatcggaacagcatccatgaccctgtgtaactcgatcagccggtcagggtagtcagcggcaaacgcatctccgctcagatccgcgccggcacagaacaccgtgccctggccagtcaacacaatcacacgggtagacacctcactgtcggcgctactagctttctgcacagcctcccgcagcttctcgataagttgcgaattcagggcattgcggcgctcgggacgctgcagctcgatagtcataacgccttcggcctgagtaatacctatcattaagccagcctatagagcctcgtcggatgagtcgtactacgaccgatcaactccgcgaggcagtgctagacgttggttcattcgttagctgagaccgcgaaccgctagcgctgccgataaccaaatcccacgcgcgggagctgactgacgcccaagccgccagtggcttagacgaatcggtgctgaccagccaggggtgcgtattcgggcgacgggtagcgataattgtctgcaaattcagcttcctcggtggccgtatcggggtggcagccgcggagcgaatcaccgccgccgtgcagcggcgacagctgagcggctgccgcgctggtctcgccaagttccgatggcacccgtatgcaggaaggcaccgtcgcgttcctgcagatggtgaagatcgctgcggccgtcaaactctccaaacgggcgggtctgccctacttagggtacttgcgtaatccgaccaccggcggggtcttcgcgtcgtggggctcgctgggccatgtaaccgtcgccgagccgggtgttctaatcggcttccttgggcctcgggtgtatgagttgctgtatggcgaacctttcccgtccgacatccagacagcggagaatctgcaacggcatggggtaatcgacgctatcgtcacgctggacggactgcaactgacgttgaatcgtgcgctgacgatgatcgccgatgttcccaaactaataccgacgccacaacgacccgaaccgataccggatgtgccagcttggaactcggttatggggtcgcgacggcctgaacggccaagtgtcgcacaagtactgcggcacggcgccaccgaccgagtgctgctgtccggacccggtcacggcgaggcagcgaccaccttgctggcactggcccgattggccggccagaccgcagtggtaatcggtcagcaacggaaggacggcggtaatcgcccagtgtctggctgagctcgtcacgctggacacaccaacagtgtcggtcctactgggtcagggcagtggcggaccgacactggccatggtgcccgccgaccgggtactggcgccactcccgccggagggcgccagcgcgattgttttccatgataccgctcatgccgccgaatttgcagcggcccagggcttccggtcgtcctgacctgatgaagtccggaatcgtcgatgtgatcgtgcccgagcacaccaccgctgccgacgagccggtcgagttttgccaacgactgtgcagtgctatcgccaccgagctacacgcgctacgcgaagtacccgattcccaacgtcttgcgacgcggttacagcgttaccgccgcatcgggctgccccacgacacttaaaccaactacctacgcacacaactcgccgcaacgcatgactgtagtttatatctgggtgaacgtgtccagtcggtcatggcaactttgcccatggatgacgcttggtgggcggcgaaaccttgtggcgcggaacgctgagctgctatcgactgcgaagacaggctgaagccgggtggctgtggtcagtccgacccggcgtcattgccgggctggccgcagcagcgctgcatgactcggatttcatcgacaacgacgaaccagtcgagctaatctggcgtaaccaaaacttaccggccgacatgatcacccgaaatcagcgcatcgatgaatgacaagcttacttgcgtcggctgaccttcggtgatgacgcttgcgcaacggtcaccgtcgaatatgacgggaaccatcaccgcaccagccgacgcaagcacatttcggaaccagtggcggctacgcaagcagcacacagctggagtggatcgttgtccgagcgatcaccgaggatattttcgttgggtacgccaaacactctaccgtcgcggatcatctcaaccaggggcggccgccgcagcgccaaccagcacactctggcctaccggtgatccggccaggtagtcagcggaccagcacaaggttgagaagttgactggcccatctacgagcggcggcttgggtcgctatcgagcaggttgaatgctcaccccgtcgtacgcagcgacgacaacgcaagcagcgttgcccattgtcccgattgcattgggtaactcaatagcgctgctgaaacggtcttcgatagctactcgcagcttagcgcgctgagcaaccaagcattggatgaggtcagggtggcacccggcgtgcatcaggaagtcggttttgacgagcagccagtcgggatcgagcaacagggtggccgcaaccctgtccacgagctcgaccagatcggcggattcgccggcgcccgcgatagcgggctgagctgttcggtgattatggtcgcgtgctggtcgtaaagcgcgaagaacaattcctcgaggcgatcgaacagcgagtaaaacacctcgtgggtgtagccggccaccgtacacacatcattctatgcgtacatacccaaatcccttgtcgtcgaacacctgaaacgtagcctcgataaaccggatgcgagcttctgcgtcacggcttgacacctgcatcggcttggcgacgtcggcaattgtggatgctacctgtctataactctataacactccaatacataggaagatcagattcaatgatgtatccgcttggcgctcagggcggcatctgtaccaatccgtagggagaccattgcatggacgctgatgtgatcgccataggcggcggtttagccggactggtcggcgacccacgaactgactgctcggggcaataagggcgcactgatagaccatgagagctaagccacctgggcggtcaagccttcgggtcgttcggtgagaattttctggtcgaaagtcccgaacagcggcgtttagggatccaagactccattacttaacacactggcctggaacgaccgttcggggaagtgcagcattcgactggctcaactatgaagatttttggaagaattttgtgtagtgaagtgagctcggtgctacgttagagttcgtcaccacagagaagcgcaactacctaactgaacagggcattcagttcatgcccatcgtggggtggtgtgagcgtcgggatatactcgtcagcgggcactacaactcggtgccccgcttgcagatgacctggaaaaccggccaccggagtcgtggagcagttcatgcattcggcccgccaagggggcggcgcgcaagctggtgacatcctatcatcgccaccacgtcgacgaactggtcttcaccaacgacgctgccaccagggtcaaagggcatagtgctggcgcctacagctcggtgcatggcgccccatccaaccgcaaggtacaagctctcggcacaaacggtaatcatctccataggagggactggcagcaaccacgacatggtgcgtagctactggccgcagcggataggcaccgcaccggcgcccatgatcaccggcgtgccgtcctacgtggacggccgggtgctcgctatcaccgctgacaacggcgtgcggctgatcaaccgcgaccagatgtttaaccacgccatccgaatcctttccggtccatcgtcgatgtggttcgacacactggaccggctgcttcccgcacctctacctgcctggttacgacaccctgggcaccgtacagtatttaccgcaccaccaccgatatcgcacattacgaacaattctggttcatcctgatccagaagatcatccagaaaaagtcgcgctattcggctcaaagcaaaacccggacatcacccctaagagccgcaaaacagttctgtgagaacggatcttcaataagcagaagccgagcccagtcgaagcgttcaaaatctatggtgccaacttcgtagcagccaaaagcctcgaagaactcgccgcgcatcaataccatcaccgacgaacccctcttggaaacggccgtgatccgcgcgcagaactaatcccggaacctacagatggccaacccgttcaacaaagactcccaagtccaggacatccgcaacgctcgttggccaaacggctcagccgggccgccaccccgcaccgcactctcgcgcctaacacgggaccgttgattgggggtgacattgcacatcctgacacaaaaaattttgggcaacatccaaatctacctcgcctaccgctagctaggtaaccgaaggtaaaatcaaccccggcctgtacgccgcctaggaggtcgccggattcagcgacggtggaatgcacgactgcaacacactggaaagcacgttcaaaagcggctgcatcttctccggacgcaccgacatcgactccctccgacctagcagcatgtcttcgacaaactgcgccgacacgtccaaacaccagcaccacgccctagctgaatccgtttcccgatccaggtacgcaagattgcgcactaaagttcaaatcccgcaacatcggcggtgattaatacacaaaatatcgttgtttatcaactgatttcaacgattacacgatcagttcccaaacagtaaccatttaaccgaaaggacgccttgtcgaaaagcagacaatgcttggagcagccgtgcagtggagcactcccccgtgacccggcgactggtactcccaccgccgtcgaaaaagatccggcaaaataggccgcatggacactggtgtaagctcacctcgagtgttggtcgtcgacgacgattccgatgtgcttgcctcgctggagcgaggcctacggctatccggattcgaggtatcgactgctatcgacggtgccgaggcgttgcgcaacgccaccgagacccggccggatgcaatcgtgctcgacatc

SEQ ID NO: 141 - protein, 255 aa, Mycobacterium leprae
  hypothetical: YES
GAAAMTETILSGGQIEVGEHHTTTWFGMTVNTDTVLSTAIAAAIVIALAFFLRTKVNSTGVPCGMQLFWEAITVQMRTQIESAIGMRIAPFVLPLAVTIFVFILISNWLSVLPLQYTNADGHTTEVLSSAAADINYVLALAFFVFVCYHLAGIWRRGIVGHPVAVLKGHVAFLAPINLVEEITKPISLSLRLFGNIFAGGILVTLIALFPPYIMWAPNAIWKSFDLFVGAIQAFIFSILTILYFSQAMEVEDHHD

SEQ ID NO: 142 - protein, 563 aa, Mycobacterium leprae
  hypothetical: YES
EDEKAMAELTISADDIQNAIEEYVSSFTADTFREEVGTVVDVGDSIAHVEGLPSVMTQELLEFPGGILGVALNLDEHNVGAVILGDFENIKEGQKVKRTGDVLSVPVGEAFMGRVVNPLGQPIDGRGDIEAEARRALELQAPSVVQRQSVKEPLQTGIKAIDAMTPIGRGQRQLVIGDRKTGKTAVCVDTILNQRQNWESGDPKRQVRCVYVAIGQKGTTIASVRRALEEGGAMDYTTIVAALASDSAGFKWLAPYTGSAIAQHWMYDGKHVLIVFDDLTKQAEAYRAISLLLRRPPGREAYPGDVFYLHSRLLERCAKLADHLGGGSLTGLPIIETKANDISAYIPTNVISITDGQCFLETDLFNQGVRPAINVGVSVSRVGGAAQIKAMKEVAGSLRLDLSQYRELEAFAAFASDLDATSKAQLERGARLVELLKQPQYQPMPVEEQVISLFLGTGGHLDSVPVGDVRRFETELLDHIRVAQEEILTEIRESQKLTDEAADSLTEVIKSFKKGFAATGGASVVPNEHVAALDEEKLDKESVKVHQAIPAKTSEKSKNSTPR

SEQ ID NO: 143 - protein, 518 aa, Mycobacterium leprae
  hypothetical: YES
ATGPDYPRDKRNRRRSKCTRQCPLGSPQGNEENMSTTKTTKMTVKTGSKGTSGRVVRVTGPVVDVEFPHGFVPELFNALNAKTTFSSLAKTLTLEVAQHLGDNLVRTISLQPTDGLVRGVEVTDTGNSISVPVGEGVKGHVFNALGYCLDEPGYGDEFEHWSIHRKPPSFEELEPRTEMLETGLKVVDLLTPYVRGGKIALFGGAGVGKTVLIQEMINRIARNFGGTSVFAGVGERTREGNDLWVELQEVNVLKDTALVFGQMDEPPGTRMRVALSALTMAEWFRDEASQDVLLFIDNIFRFTQAGSEVSTLLGRMPSAVGYQPTLADEMGELQERITSTRGRSITSMQAVYVPADDYTDPAPATTFAHLDATTELSRSVFAKGIFPAVDPLASSSTILDPGIVGEEHYRVAQEVIRILQRYKDLQDIIAILGIDELSEEDKQLVNRARRIERFLSQNMMAAEQFTGQPGSTVPVKETIDAFDRLCKGEFDHVPEQAFFLIGGLDDLTKKAESLGAKL

SEQ ID NO: 144 - protein, 85 aa, Mycobacterium leprae
  hypothetical: YES
GGQSMDPMIAQGALIGGGLIMAGGAIGAGIGDGMAGNALVSGIARQPEAQSRLFTPFFITVGLVEAAYFINLAFMALFVFATPVK

SEQ ID NO: 145 - protein, 457 aa, Mycobacterium leprae
  hypothetical: YES
HHRFRCDEIASMSTFIGQLVGFAAIVYLVWWYVVPPVCRLMRARRDAVRQQLTEAAEAADRLVEASQAHTKATEDAKVEAQRVVKEAVEDAKRIVEQLQAQADVEAERIKLQGARQVELLRAQLTRQLRLKFGHESVRQAAELVRNHVADAVQQSATVDRFLDDLDAMTPKGADVEYPLLAKMRSASRRALVDLADRFGAIAKSLDNQALYTLAGELVSVAKMLDREIVVTRYLTVPVEDEAPRVKLIDRLVSAHVGDPTMEILRAAVSERWSANTDLVDALEHISRQALLEVAEREDQIDEVEDQVFRFSRILDVAPRLAILLDDYAVPADSRVRLLCNVLQSASSVVNPIAVALLSQTVELLRGQPAKEAILFLAEVAVARRGEVVAQVSAAAEISDAQRTRLTEVLSRIYGHPVTVQMQIDAALLGGLSIVVGDEVIDGTLSSCLVAAEAALPD

SEQ ID NO: 146 - protein, 127 aa, Mycobacterium leprae
  hypothetical: YES
QRKVLCMDELNIEIVAVDRKIWSGKGTFLFTRTTAGEIGILPRHIPMVAQLVDDNMVRIEREGEKDLRVAVDGGFLSVTEERVSILAESAEFDSEIDENAAKQDAESDDPRIAARGRARLRAVGAID

SEQ ID NO: 147 - protein, 177 aa, Mycobacterium leprae
  hypothetical: YES
FGYDGLSMFEVSAIVFAVSQAAEEGKSSNFLLPNGTFFFVLAIFLVVLGVIGTFVVPPILKVLQERDAMVAKTDADSKMSAAQFAAAQADYEAAMKEARVQSSFLRDNARVDGRKSIEEARVRAEQHVVSTLQIAGEQIKRERDAVELDLRAKAGAMSLILASRILGVDITASVVTR

SEQ ID NO: 148 - protein, 308 aa, Mycobacterium leprae
  hypothetical: YES
HTQVIEGNGDMAATLRELRGRIRSVGSIKKITKAQELIATSRIARAQVRLESARPYAVDITRMLTTLAYEAVLDHPLLVASATPKRAGVLVVSSDRGLCGAYNANVFRRSEELFSLLRAEGKTPILYVVGRKALNYYTFRNWGIAESWTGFSEQPKYENAAKIASTLVDVFMLGSSESDAGVDELHIVFTEFKSMLSQSTKARRMAPMVVEYVEESKLPRTLYSFEPDATTLFEALLPRYLTIRVYAAMLESAASELASRQRAMKSATDNADDLIKALTLEANRERQAQITQEISEIVGGANALANAR

SEQ ID NO: 149 - protein, 517 aa, Mycobacterium leprae
  hypothetical: YES
LLPGIAPRRREAYRPAHRAFGPVPGQSSGYCQRAGDPRSQCSGADVNVHTAGPRHAEKTRHTATPQRVQPSDDLLRLASNVWPRNITRDETGVACIAGNKLTDLAGEYGTPLFVIDEDDFRFRCREIAAAFGGGENVHYAAKAFLCTEIARWIDEEGLSLDVCSGGELAVALHASFPPERISLHGNNKSVAELKDAVKAGVGYIVLDSTTEIERLDAIAGEAGIVQDVLVRLTVGVEAHTHEFIATAHEDQKFGLSVASGAAMAAVRRVFATDNLRLVGLHSHIGSQIFDVAGFELAAHRVIGLLCDIVGEFDPEKTAQLSIVDLGGGLGISYLPDDDPPPIFELAAKLGAIVSNESAAVGLPVPKLMVEPGRAIAGPGTITLYEVGTIKDVDVSATAHRRYVSIDGGMSDNIRTALYDAQYDVRLVSRTSDAPAAPASIVGKHCESGDIVVRDTWVPDDLKPGDLVGVAATGAYCYSLSSRYNMLGRPAVVAVCAGQARLILRRETVDDLLSLEVR

SEQ ID NO: 150 - protein, 442 aa, Mycobacterium leprae
  hypothetical: YES
PVFSDERTVGVAVLGLGNVGSEVVRIIEGSADDLAARIGAPLMLRGIGVRRVAVDRGVPVDLLTDNIEELVSRADVDIVVEVMGPVELSRKAILSALEHGKSVVTANKALLAASTGELAQAAESAHVDLYFEAAVAGAIPVIRPLTQSLAGDTVLRVAGIVNGTTNYILSAMDSTGADYDSALAGARALGYAEADPTADVEGHDAAAKAAILASIAFHTRVTADDVYREGITKITPADFVSARALGCTIKLLFICERITAADGQQRVSARVYPALVPMSHPLATVSGAFNAVVVEAEAAGRLMFYGQGAGGAPTASAVTGDLVMAARNRVLGSRGPKESKYAQLPMETIGFISTRYYVSMNVADKPGVLSGVAAEFAKREVSIAEVRQEGVVDDGGRRVGARIVVVTHGATDAALSETVDALADLDVVQGVTSVLRLEGISL

SEQ ID NO: 151 - protein, 341 aa, Mycobacterium leprae
  hypothetical: YES
GWSSGDRKCDAVGCGGAPLVGLSERLLVTWMLPAGLVASAVVAASSANLGPGFDSIGLALSLCDEIVVETTDSGLVVVVDGEGADQVPMGPEHLVVRAVRRGLQAVGVSAAGLVVRCRNAIPHSRGLGSSAAAVVGGLAVVNGFVAQIDSTPLSNAQLIQLASEFEGHPDNAAAAVLGGAVVSWVDRSYDQPDYCAVPLRLHPDIHLFAAIPEERSSTAESRVLLPARVSHDDARFNVSRAALLVVALTERPDLLMAATEDVLHQPHRASAMSASAEYLRLLRRHNVAATLSGAGPSLIALSTQSELPREAAEYGAANGFIIIKMTAGDEVCWRPEVTVPG

SEQ ID NO: 152 - protein, 703 aa, Mycobacterium leprae
  hypothetical: YES
PPPWCGLSGTSPPPWNVISGEVGIGASFQWCLLISMEGSTERHAWGMGRASLAEKSPLNCSKAGAPGRIRTCDLLLRRQMLYPLSYGGVQITCCTSGLQQISASGWLGDIIQFVPASGKMSPLLTATPSELLRGWLLLRRIRALWPQPIGWTFVTPADLAELLKTTAIVVLAERGLDAAALPQTVTVERPRNPEHGDYSSNLAMQLGKKVGANPLELAGWLAEVLAQAGGIADVEVAGPGFINMRLDASAQAMIVNTVINADKNFGHSDDLAGYQINLEFVSANPTGPIHIGGTRWAAVGDALGRLLSTQGAAVVREYYFNDHGAQVDRFTNSLIAAAKGELTPADGYAGTYVTDIAAQVMQQAPYALSLPESEMHETVREIGVDLMFTHIKKSLHEFGTDFDVYTHEDSMHASGRVDEAIARLRDTGNVYEKDGALWLRTSAFGDDKDRVVIKSDGKPAYIAGDLAYYLDKRQRGFDLCIYMLGADHHGYIARLKAAAAAFGDDPAIVEVLIGQMVNLVCDGQLVRMSKRSGNVITLDDLVEAIGVDAARYSLIRSSVDTPIDIDLALWSSSSNENPVYYVQYAHARLSALARNAAEFGLIPDTGHLELLSHDKEGALLRTVGEFPQVLKTAAALREPHRVCRYLEDLAGDYHRFYDSCRVLPQGDEKPTDLHTARLALCQANRQVIANGLAILGVSAPERM

SEQ ID NO: 153 - protein, 430 aa, Mycobacterium leprae
  hypothetical: YES
LTSRYRFTRLTRVAERFVVTGGNRLSGEVTVGGAKNSVLKLMAATLLAEGTSTITNCPDILDVPLMAEVLRGLGATVELYGDVARITSPDEPKYDADFAAVRQFRASVCVLGPLVGRCKQARVALPGGDAIGSRPLDMHQAGLRQLGARCNIEHGCVVASAETLRGAEIQLEFPSVGATENILMAAVVAEGVTTIHNAAREPDVVDLCTMLNQMGAQVEGVGSPTMTITGVPRLYPTEHRVIGDRIVAATWGIAAAMTRGDIAVTGVDPAHLQLVLHKLHDAGATVTQTDDSFRVAQYERPKAVNVATLPFPGFPTDLQPMAIALTSIADGTSMITENVFEARFRFVEEMIRLGADARTDGHHAVVRGLPQLSSAPVWCSDIRAGAGLVLAGLVADGDTEVYDVFHIDRGYPLFVENLANLGAEIERVCL

SEQ ID NO: 154 - protein, 199 aa, Mycobacterium leprae
  hypothetical: YES
LTLVPCLVMAIHLTRIYTRTGDNGTTGLSDFSRVAKTDLRLVAYADCDETNSAIGVALALGNPDQKITDVLQQIQNDLFDAGADLSTPMQDSVRNPEYPQLRITQTHIDRLEEWCDTYNTPLPTLNSFVLPGGSPLSALLHVARTVARRAERSAWAAVEAHPGVVSMLPAKYLNRLSDLLFILSRVANTGNDVLWRPGG

SEQ ID NO: 155 - protein, 198 aa, Mycobacterium leprae
  hypothetical: YES
AVKVATGMMIRLRRAIDSAVTQLEEAGIGSARCDAEQLAAHLAGTDRGRLALLDTPGEEFFRRYSDAVAARSRRVPLQHLIGTVSFGPVVLHVGPDVFIPRPETEAILAWVMAQRLPERPVIVDACTGSGALAVALAHHRPAARVIGIDDSDSALDYARRNAEGTAVECVRADVTTPALLPELDGCVDLFVAQPTLRS

SEQ ID NO: 156 - protein, 361 aa, Mycobacterium leprae
  hypothetical: YES
YAQPVQSIDVLLIEHAELELALADPELHSNPAEARKAGRRFARLAPIVATHRKLISARDDLQTARELAAGDESFADEIAELESRIAELTTQLTDMLAPHDPHGPDDIVLEVKSGEGGEESALFAADLARMYIRYAERHGWTVTVLDETTSDLGGYKDATLAISHKGASDGDAVDGVWSRMKFEGGVHRVQRVPVTESQGRVHTSAAGVLVYPEPEEIGEVHIDESDLRIDVYRSSGKGGQGVNTTDSAVRITHLPTGVVVTCQNERSQLQNKTRALQVLAARLQAMAEEQALANASADRASQIRTVDRSERIRTYNFPENRITDHRIGYKAHNLDQVLDGDLDALFDALSAADKQSRLQQV

SEQ ID NO: 157 - protein, 403 aa, Mycobacterium leprae
  hypothetical: YES
AGLRLVQYVREMSSDLATFASGLLALFERSAGVPLRELALVGLTAAIITYFATGLVGVLANRLEAVAYPRERDVHVTPTPRMGGLAMYLGVLAAVFLASQLPALTRGFVYSSGMPAVLVAGAVITGIGLIDDRWGLDALTKFAGQITAASVLVTMGVAWSVLYIPLGGVGTIVLDQTSSILLTLALTVSIVNAINFVDGLDGLAAGLGLITAMAICIFSVGLLRDHDGDVLFYPPAVISVVLAGSCLGFLPHNFHRAKIFMGDSGSMLVGLMLAAASTTAAGPISQNAYGTRDVFALLSPFLLVVAVMFVPMLDLLLAIVRRIRAGRSAFSPDKMHLHHRLLQIGHSHRRVVLLIYLWVGIVAFGAASTIFFNPRNTGAVMLGAIVITGMATVIPLLRRRDNY

SEQ ID NO: 158 - protein, 618 aa, Mycobacterium leprae
  hypothetical: YES
SAREERKSVTETDLITVGENTDDTELTNAVTTDTPDVKATAATVSLGSLSTMVLPELRALANQAGVKGTSGMRKSELIAAIEECRGQANGTSVNDGPSRDHGGSATAISTEALAAQEEQNYAIVEVSRRERRGASREADVTAGTSTAEATESDCQGTADDDTRTLQGGQSDTKTEERGPDVGNDQGVEQQSSSLQPRGDDDGEGRQGRRGRRFRDRDRRRRGERSGDGAEAELRQDDVVQPVAGILDVLDNYAFVRTSGYLAGPHDVYVSMSMVRKNGLRRGDAVTGAVRVPREGEQGHQRQKFNPLVRLDSINGGSVEDAKKRPEFGKLTPLYPNQRLRLETTPDRLTTRVIDLIMPIGKGQRALIVSPPKAGKTTILQDIANAITRNNLECHLMVVLVDERPEEVTDMQRSVKGEVIASTFDRPPSDHTSVAELAIERAKRLVEQGKDVVVLLDSITRLGRAYNNASPASGRILSGGVDSTALYPPKRFLGAARNIEEGGSLTIIATAMVETGSTGDMVIFEEFKGTGNAELKLDRKIAERRVFPAVDVNPSGTRKDELLLSPDEFGIVHKLRRVLSGLDSHQAIDLLMSQLRKTKTNYEFLVQVSKTTPGSMDDD

SEQ ID NO: 159 - protein, 154 aa, Mycobacterium leprae
  hypothetical: YES
SRDCRRVGTAGSSWPIGRECTGASGCLGWWRLTWHNWRSTTTEPPPVFGVPAWLPDRHGDQGGRRPNRDTMKANIHPAYAETTVVCGCGNTFQTRSTKPGGRIVVEVCSQCHPFYTGKQKILDSGGRVARFEKRYGKRKVGVDQVAAYPEQNNK

SEQ ID NO: 160 - protein, 222 aa, Mycobacterium leprae
  hypothetical: YES
GEVVRMNEVFDCADPDQRARGIASAVAALKGGRLVVMPTDTVYGIGADAFDRAAVAALLSAKGRGRDMPVGVLVGSWHTIEGLVYTMPDGARELIRAFWPGALSLVVVHAPSLNWDLGDAHGTVMLRMPLHSVAIELLCEVGPMAVSSANVSGQPAAVDVDGARGQLGELVGVYLDAGPSAQQAASTIVDLTEATPRILRAGPVSVARIAEVLGVVPASLIA

SEQ ID NO: 161 - protein, 378 aa, Mycobacterium leprae
  hypothetical: YES
LRRRAGCHKCVATGRNQPVSGQQTTTHQPWPGVIAAYRDRLPVGDDWTPVTLLEGGTPLIAAPRLSEQTGCTIHLKVEGLNPTGSFKDRGMTMAVTDALARGQRAVLCASTGNTSASAAAYAARAGITCAVLIPQGKIAMGKLAQAVMHGAKIIQIDGNFDDCLELARKMAADFPMISLVNSVNPVRIEGQKTAVFEIVDALGTAPHVHALPVGNAGNITAYWKGYTEYHADGLIDRLPRMLGTQAAGAAPLVLGEPVSHPETIATAIRIGSPASWTSAVEAQQQSKGRFLAATDEEILAAYHLVARAEGVFVEPASAASIAGLLKAIDGGWVARGSTVVCTITGNGLKDPDTALKDMPSVSPVPVDAVAVVEQLGLV

SEQ ID NO: 162 - protein, 149 aa, Mycobacterium leprae
  hypothetical: YES
LSMSAPMVGMVVLVVTLGAAVLALSYRLWKLRQGGTAGIMRDIPAVGGHGWRHGVIRYRGEAAAFYRLSSLRLWPDRRLSRRGVEIVARRGPRGDEFDIMTDKIVVLELRDTTQDRRSGYEIALDQGALAAFLSWLESRPSPRTRRRSV

SEQ ID NO: 163 - protein, 74 aa, Mycobacterium leprae
  hypothetical: YES
TWIDENHRAQLNIVADGARIVADMRDEKQPFEANTAGNVMTVRVNDVGTQFERTVVAGVRVLESSTDHVYGERE

SEQ ID NO: 164 - protein, 156 aa, : Mycobacterium leprae
  hypothetical: YES
GSAVTTPAQDAPLVLPAVAFRPVRLFIINIVLTGLAMLAAGLSGHLMVGVFFGIGLLLGLLNALLVRCSVESITAQGHPLKRSMALNSASRLAIITVFGLIIAYAFPLAGLGVVFGLALFQVLLVLSTMLPVWRKFRFGEADGGVLKGSEGEEQQR

SEQ ID NO: 165 - protein, 93 aa, Mycobacterium leprae
  hypothetical: YES
SVLAARGHSSRLIHTVAGGFACFRQGSGLSLNLSSNCSICMCIHTVLTLGQHQILFVDEVRRFGRRSWRSPLIRVDDWARSALWLNATTPRMT

SEQ ID NO: 166 - protein, 128 aa, Mycobacterium leprae
  hypothetical: YES
NACVPMSPPRLCCLNLMDASISLWPNPPYVPDDPVVQSILEPEVTQYDPRHAVFGGPDGMALTADIVGLAGRWLRPGGLFAVEHDDSTSVPTLDLVYRTDLFDDVLTHRDLAGRPRFVTARRRESWSA

SEQ ID NO: 167 - protein, 189 aa, Mycobacterium leprae
  hypothetical: YES
TTMRSDRGKPNAWAICVFCAAGPMHPELLELAAELGEAIAERGWTLVWGGGRVSAMGAVASAAWTRGGRIVGVIPEMLQRREIADTYVGELIVTETMAERKQVLDDHADAFIVLPGGLGTLDELFEAWTAGYLGMHRKPIVMLDPWGHYEGLWAWLHGLIDSGYVSPVAMERLVVVDQVDAALEACMSV

SEQ ID NO: 168 - protein, 471 aa, Mycobacterium leprae
  hypothetical: YES
AARQAEQQAITDLTGSAGYGDLEGTWAHFDYSLSERGSARAIGTSFKLGWKLAHPYRPEIFGPAVLLPSGTHSNTQSVLHCSGQNAYHKTPPNNTCAAMGVEMFPGFDPLPEALRPVTKPRLYTPHVHPIFPPLTEPLVDCGVYVGGHRLPDKYTTYTAALSRVREIELMGNEGFVWIGLHEPEASHMHNVADVFGLHPLAVEDAVHAHQRPKLERYDDTLFLVLKTVNYVPHESVVLARQIVETGEVMIFVGKNFVVTVRHGEHGELSEVRKRMDTDPEHLRLGSYAVMHAISDYVVDRYLAVTNLMEGDIDAIEEVAFAPGRKLNVEPIYLLKREVIELRRCVAPLSAALQRMQTDNKDLISKELRRYLRDVADHQTEAADQIASYDDMLNSLVQAALARVGMQQNNDMRKMAAWAGIVAMPTMVAAIYGMNFRFMPELNWTWSYPLVMAGMTIVCLVLYWQFRNRNWL

SEQ ID NO: 169 - protein, 292 aa, Mycobacterium leprae
  hypothetical: YES
LVQSMLCGRPVAADRQLIMAIVNRTPDSFYDRGATFSDEAARAAAHRAVAEGADVIDVGGVKAGPGQGVDVDTEIARLVPFIEWLRSAYTDLLISVDTWRAEVARLACTAGADLINDSWGGADPAMHEVAAELGAGLVCSHTGGALPRTRPFRVSYGTTTRGVVDDVIRQVTAAAERAVAAGVTRDSVLVDPTHDFGKNTFHGLLLLRHVDELVKTGWPVLMSLSNKDFVGETLGVGLTERLEGTLAATALAAAAGVRMFRVHEVVATRRVLEMVASIQGTRPPTRTVRGLA

SEQ ID NO: 170 - protein, 430 aa, Mycobacterium leprae
  hypothetical: YES
RTGTSGRRRRGMPPWQRWAAADRFGAMREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 171 - protein, 541 aa, Mycobacterium leprae
  hypothetical: YES
LRADQAGTVNTRVDTDNAVIRYRRRNRPCLERSEEDNVTSDQGTNNDQNPGHHLATRPVARPPVDAASREAFGRPCGFSGSFVAEYVRPQKYRDRSEFRPDDQPADPVLAEAFSRPFGSVDSLQRHPIDAGALAAEKDATQLDEPDDPWRDPAAAATLASPAVASPVPHTELGQCGKLGVRDVLFGGRVSYLALVILVFIALALGAIGGVIGRKTAEIVDAFTTSKVTLATTNNTEEPAGRFAKVAAAVADSVVTIESKSDQEEMQGSGVIIDGRGYIVTNNHVISEAANKPSQFKTTVVFNDGKDVPANLVGRDPKTDLAVLKVDNVDNLTVARLGDSGKVRVGDEVIAAGAPLGLRSTVTHGIVSALHRPVPLSGEGSDTDTVIDAIQTDASINHGNSGGPLIDMDSQVIGINTAGKSLSDSASGLSFAIPVDEMKSVVQTLIKDGKIVHPTLGVSTRSVSNAIASGAQVANVKAGSPAQKGGILENDVIVKVGNRKVADADEFIVAVRQLTIGQDASVEVVRDGRHVTLTVKSDPDSS

SEQ ID NO: 172 - protein, 344 aa, Mycobacterium leprae
  hypothetical: YES
IPSPTLTRSPWPTGSLRRCKRLSTGRACCRDRLLVGRAAAMTAVVGKSWHVRASSVQPEQRLAFLLVTPAAMLMLVVTAYPIGYAVWLSLQRYSLATPNETVFIGLGNYQTILTDPYWWTALAVTLAITVVSVSIEFILGLMLALVMHRTLLGKSLVRIAVLIPYSIVTVVASYSWYYAWTPGTGYLASLLPQGSVPLTEQIPSLSIVIIVEVWKTTPFMSLLLLVGLALVPEDLLKAAQMDGAGAWRRLTKIILPIIKPAVMVALLFRTLDAFRIFDNIYVLTRGVNNTDSVSILGYDNLFKGFNVGLGSAISVLIFGCVALIAVIFIKVFGVVAPGGDSNGY

SEQ ID NO: 173 - protein, 302 aa, Mycobacterium leprae
  hypothetical: YES
FSSRCSVSWRPEVTAMGIEKVKVTAGVRVGARRATIWVIIDTFVVGYALLPVLWILSLSLKPASTVKDGKLIPSLVTFDNYRGIFRSDLFSSALINSIGIGLTTTVIAVMFGAMAAYAIARLAFPGKRLLVGTTLLVTMFPAISLVTPLFNIERRVGLFDTWAGLILPYITFALPLAIYTLSAFFAEIPWDLEKAAKMDGATSGQAFRKVIVPLAAPGLVTAAILVFIFAWNDLLLALSLTSTKAAITAPVAITNFTGSSQFEEPTGSIAAGAIVITAPIIVFVWIFQRRIVAGLTSGAVKG

SEQ ID NO: 174 - protein, 263 aa, Mycobacterium leprae
  hypothetical: YES
GCARRSTPSTSRTFFALRCFEIERWVVGMLDCPVMYDDQNGTAIVVLVAPMVAIILLGRGMSSLNVVGVRRRYRRGYFHESFSYHRCFRHYCARFAWHSAYRVRRHELREVSLIWRDVPTPAVSPATWPRCSLALLCSLGCRRSWSLEELLVMMAPDGIVFVLSDPDPEIHPGVAAKYVAVVAIGRSDFCSQINSVLVFPGVFCGALDAETSRITEKMMVAAVEAIFCVASDDFTLDRIVPSLLNFRVGEAGALATEASDVAG

SEQ ID NO: 175 - protein, 333 aa, Mycobacterium leprae
  hypothetical: YES
GVIEVSPRPLKVAVTGAAGQIGYSLLFRLASGSLLGLDRPIELRLLEIEPALKALEGVVMELDDCAFLLLAGVEIGADPNKVFDGVNLALLVGARPRGPGMERGDLLEANGAIFTAQGKALNAVAAADIRVGVTGNPANTNALIAMTNAPDIPRERFSALTRLDHNRAIAQLATKTGSAVTDIRKMTIWGNHSATQYPDVFHAEIGGKNAAEVVGDQAWIEDYFIPTVAKRGAAIIDARGASSAASAASATIDAARDWLLGTPEGNWVSMAVVSDGSYGVPEGLISSFPVTTTDGDWTIVRGLGIDDFSRGRIDKSTAELADERMAVKQLGLI

SEQ ID NO: 176 - protein, 218 aa, Mycobacterium leprae
  hypothetical: YES
QCGHPRPSGRQSSRFTLRTRRGVDIRRRILASARERSEEIGARAVTPAVGALLSLLTKLSGGKAVAEVGTGAGVSGLWLLSGMSYDGVLTTIDIEPEYLRLAKQAFSEAGIGPSRTRLISGRGQDVLTRLADESYDLVFIDADPIDQPAYVVEGVRLLRSCGIIVVHRAALGGRAGDPAARDAEVTAVREAARLIAENERLTPALVPLGDGLLAAVRE

SEQ ID NO: 177 - protein, 236 aa, Mycobacterium leprae
  hypothetical: YES
GGLGAGPARPRARGVTWSARGYRRRRSRCRCLECSQRGRRPGCDVSDDGLVRCGWADVRSGLHWQLYRNYHDQEWGSPVRCGVALFERMSLEAFQSGLSWLLILRKRENFRRAFSGFDIEEVARYTHADVQRLLFDDGIVRNRVKIEATIANARAAAELGSAADLSELLWSFAPQPRSRPADGSEIPSTSAEAKAMARELKRRGFRFVGPTTAYALMQATGMVDDHICTCWVPPTR

SEQ ID NO: 178 - protein, 439 aa, Mycobacterium leprae
  hypothetical: YES
AAANVCSWLAPGTSQPVAPLPCCHTDLHRPIELGARSGQLTTRRAERTSSHLHSAVMSRTDRNAADLKSAVSTALAKVIDPELQRPITELGMVKNIDIEPGGNVQVGIYLTIASCPKKSEISKRVTKAIADVPGTAAVEVSLDVMSDEQRTKLRKKLRGDAREPMIPFAQPNSLTRVYTVASGKGGVGKSTVTVNLATAIAARGLAVGVLDADIHGHSIPRMMGSNQRPIQLESMILPPIVHEVKVISIGQFTEGNTPVIWRGPMLHRALQQFLSDVYWGDLDVLMLDLPPGTGDIAISVAQLIPNAEILVVTTPQLAAAEVAERAGSIALQTRQRIVGVVENMSGLMMPDGSRLQVFGEGGGQQVAERLSRAVGTDVPLLGQIPLDPALVAAGDSGIPIVLNASDSPVGKELLRIADGLSSRQRRLAGVSLGLDPSRR

SEQ ID NO: 179 - protein, 199 aa, Mycobacterium leprae
  hypothetical: YES
NHLTRCRAPRYSTRLGTRQRCLLWEELVRQHAARVYWLAYRLSGNQHDAEDLTQETFIRVFRSVQNYQPGTFEGWLHRITTNLFLDMVRRRARIRMDALPDDYDRVPADEPNPEQIYHDSRLGPDLQAALDSLPPEFRAAVVLCDIEGLSYEEIGATLGVKLGTVRSRIHRGRQALRDYLLTAHPRDGATTDATHVKSA

SEQ ID NO: 180 - protein, 104 aa, Mycobacterium leprae
  hypothetical: YES
LTRNRTEVFCIREMLPIGKMREILSTATVFVCPSVHEPLGIVNLEAMACATAVVAPDVGGVPEVIADGITGSLVHYNPDDPTGYQGRLATAVNDLVANPGKAEG

SEQ ID NO: 181 - protein, 112 aa, Mycobacterium leprae
  hypothetical: YES
WITCLNICVAEACNRGVTMLLSSHILTEPEALCRRVTIIRASKIVKSGSLTSLRHLSRTSIKAEIICDPGKYKLDPGCLGRERRRQHAERPGQQSNPLGTRSGYSVTPVYAA

SEQ ID NO: 182 - protein, 107 aa, Mycobacterium leprae
  hypothetical: YES
LCALDELDLTVHTGQMHGFLGPNSTEKCTTIHILLVLANTDSENTTTTTRRRHLDRPRRISPEDRLCARNCHAVVFANRNRNYRFAGPHAWRHRRELARRATKALRP

SEQ ID NO: 183 - protein, 105 aa, Mycobacterium leprae
  hypothetical: YES
VSRRNRMPLFLNAEPQALTAAANTLEGLSAATVASNAAAAQLTTEIAPPAADDVSILLAHFFSGHGRQYQAHASQGATNHQDLIQSLLTSSSAYAGTETANHDSL

SEQ ID NO: 184 - protein, 101 aa, Mycobacterium leprae
  hypothetical: YES
RMTAAHFMTDPQAMRDMARKFDMHAQNVRDESHKMFMSSMDIAGAGWSGTAQLTSHDTMGQINQAFRHIVTLLQDVRDQLGTAADRYEHQEENSRKILSGS

SEQ ID NO: 185 - protein, 112 aa, Mycobacterium leprae
  hypothetical: YES
LRKSLLINTFSAGGDKVMGNINYQFGEIDAHGAAIRAQAAALETTHQAILATVRDAAEFWGGQGSTAHEMFIADLGRNFQMIYEQANSHGQKVQRASSSMADTDRSVSSAWS

SEQ ID NO: 186 - protein, 119 aa, Mycobacterium leprae
  hypothetical: YES
EQVQRRTRWISGRYYAEINSAKMYFGLGSGSMLVDVFPAAEEVVEDTVLVLVGDEAAALEQLLGQTADVAGAAKSGPVQPMGDRGSVSPVGQMVRSALRTPTRAFAMPSSPAAGSLHLG

SEQ ID NO: 187 - protein, 328 aa, Mycobacterium leprae
  hypothetical: YES
RLPGRASNLTAVTGTAGGVGIGLATLAADGSILDTWFPAPKLTESGTSVTSQLAMSDVPYELAVLTGRDDDRGTETIAVRTVIGSLDEVAADAYDAYLRLHMLSHRLVAPHGLNADGLFGVLTNVVWTSRGPCAIDGFDTVRAQLRRHGPVTIYGVDKFPRMVDYVVPTGVRIANADRVRLGAHLAPGTTVMHEGFVNYNAGTLGASMVEGRISAGVVVGEGSHVGGGASIMGTLSGGGTQVISIGKRCLLGANSGLGISLGDDCIVEAGLYVTTGTKVNTPEGKSVKARALSGGSNLLFRRNSVTGAVEVVARDGRGSTLNEALHTN

SEQ ID NO: 188 - protein, 409 aa, Mycobacterium leprae
  hypothetical: YES
RWCPIRSVSVRETRCRGSIRRRPASPARCQPHLQFLSRRSGYLLGLEDVISTLVCVLDLRGDPIELTAALVDIPSESRAEARIADAVETALRAQTAGFEIVRNGNAVLARTSLHRPARVLLAGHLDTVPVAGNLPSRCEKDVLHGCGTVDMKSGDAVFLHLAATVTEPVHDLTLMFYDCEEIDSAANGLVRIERELPEWLAADVAILGEPTGGYIEAGCQGTLRVVINAAGSRAHSARSWLGDNAIHKLGAVLDRLAAYRARTVDIDGCVYREGLSAVRVDGGVAGNVIPDAASVTVNYRFAPDRSVAAALRHVHDVFDGLDVQIEQTDAAVGALPGLSQPAAKALVEAADGQVRAKYGWTDVSRFAALGVPAVNYGPGDPNLAHRHDERVPVVQITAAVDMLRRYLGG

SEQ ID NO: 189 - protein, 81 aa, Mycobacterium leprae
  hypothetical: YES
EASAATLCAERQGRFYNVEPMAQRALATRDPAALTAVSAKLAAIGIISVAAVAVAERLPDADHGRPKISRRGIDATYPQQR

SEQ ID NO: 190 - protein, 134 aa, Mycobacterium leprae
  hypothetical: YES
PADNPMIYTAHPLFGERERAALDADGARWRRTDLVVLHLRHSSDNLSDQPRLASLVLDSDAPKQLDEVAAAKQTLRLSDLHTGLTTNPLERCNASQTPKPGCTTVANQRPGKSEAGTPVRCQTTPTPQHCRHRI

SEQ ID NO: 191 - protein, 86 aa, Mycobacterium leprae
  hypothetical: YES
GRTVCDMAAFVDRLGDAFRWKGNKVATTQVEVVLTSDKSVEECMIFGIEVSCTAGCAGMAAIKRGEGAEFDGRFLARAVYGQLYAY

SEQ ID NO: 192 - protein, 140 aa, Mycobacterium leprae
  hypothetical: YES
GFMHRRLRRDGCDQAGRRRRIRRPISGPRGVRPVVCLLAAAVRAGWSSRLCTPPRARVARWRCVSKLMTLNVAGPLNVLVCRADGYFPYTYYDRLTSRSVVCQVSDCKADVPAHAECATGRTLGVKDGPATMRLVVTRQY

SEQ ID NO: 193 - protein, 383 aa, Mycobacterium leprae
  hypothetical: YES
GLRRGDSGRGFDGTARGYVGGHCVGGGSWRPHVSGARGRSDQAGSGDGGFDPGDASPNAHGEGTRMTASELIASALAARSGDAWLADRSWSRPAWTIDELVAAKAGRAISVVLPALNEEQTIESVIDSISPLVSDRAGLVDELIVLDSGSTDETEIRAIAAGARVVSCEQAMPEVPTRPGKGEALWRSLAVTSGDIVVFVDSDLINPHPMFVPWLVGPLLTGDGIHLVKGFYRRPLNSNDAGGSARATGGGRVTELVARPLLASLRPQLGYVLQPLSGEYAATRELLTALPFAPGYGVEIGLLVDTFDRLGLDAIAQVNLGVRAHRNRPLAELGAMSRQVIATLLSRCGILDSGVGLTQFFVDESDGDGYIRHTWSVSLADRQ

SEQ ID NO: 194 - protein, 119 aa, Mycobacterium leprae
  hypothetical: YES
GNIVPVALVLLYLVVLVLVAIVLFGAASLLFGRGERLPPLPRGTTATVLPAHGVTGADVDAVKFTQVLRGYKPSEVDWVLDRLGRELEALRGQLAAIADAEADADVSNVPSGDDGQDVT

SEQ ID NO: 195 - protein, 80 aa, Mycobacterium leprae
  hypothetical: YES
IPRGGMLGAEWVREGGPARVWREHTMAAMKPRTGDGPLEATKEGRGIVMRVPLEGGGRLVVELTPDEAAALSDELKGVTS

SEQ ID NO: 196 - protein, 134 aa, Mycobacterium leprae
  hypothetical: YES
YTCYTGLAGHLAALLYDIPHALTAHSLEPLRPGKAEQSNSGYRVSTWVEHTAVLGAHAIIAVSSGMLRIYPTLDPRLVHVIWNAMYSIRPGSGTVRARYRLKLAHCGVRGTDGSPDRKGVAHLATAAHRFSPDV

SEQ ID NO: 197 - protein, 218 aa, Mycobacterium leprae
  hypothetical: YES
AMIVVGNFTQSNYVPASRGRRSSQLSGDDREQAILAVAERLLAERPLGDFSVDELAKGAGISRPTFYFYFPSKNAVLLSLLDDLNMKSRSAVEALAEQLPADPAAVWRSAITAFFEVCGTHRAVAVAGAAAKATSPEVRRLWSTVMQQWIDYNTAAIQAERKCGVAPDTIPAEDLAVALQLMTERVMAATFSDEKPLIPDKKVIDTLVHIWLASIYGS

SEQ ID NO: 198 - protein, 138 aa, Mycobacterium leprae
  hypothetical: YES
VGTWVSLQGDALVAARLGITVLVVIQNGYAATTVTVEAGQTMSVGGIYKFIRHPMYVGNVIHGKGAYRWRSGPTGAAGHPRCGGARLPHPRRGEGSFTQELSGYRQYTQQVRYRLAPYVWCAVNCRKCWPTRYARACR

SEQ ID NO: 199 - protein, 140 aa, Mycobacterium leprae
  hypothetical: YES
AIIWLDPRQQSWSQRLASVLVYSATAGNVDGMVAIMAGTATVQLTAIWLLTAVKVQLLNLARRFTPVPWVVLIAFFAFYLIGSLAGFSQWVFDLEPFTFTHVPWVGGGDFTIVPLLWLLAIDAVLITLVTKAFQRCDLCN

SEQ ID NO: 200 - protein, 86 aa, Mycobacterium leprae
  hypothetical: YES
LRPPMPNSRIPSIMASPTQHTPYGQIYNNSLRAADIRKAGMFHLLIAVAFTMMGMVADAFTTSLTLRLHQKESSQRTEIAWPVLFF

SEQ ID NO: 201 - protein, 90 aa, Mycobacterium leprae
  hypothetical: YES
WMTTKCTLTRKYASETRKPSRDPQTRAKYLAITGSSSYLLYLHIHENSTELRELLRDYAREILLPSTGNLRRPIDGRIEYQLSEPIEIVS

SEQ ID NO: 202 - protein, 124 aa, Mycobacterium leprae
  hypothetical: YES
TAVCSYIAYTPMGDGIGMEREGRWTGNTQCPLRVVPGDESPTLDGRASPEDLIITNLLSPTIMSHPPPSRDDDWVEPFDALQGTAVFDATGDKATMPAVGGIGASTRGSGILASLSPFRQPARR

SEQ ID NO: 203 - protein, 370 aa, Mycobacterium leprae
  hypothetical: YES
ISRQLSGGLLSAELPGGLRSNTARNERDGDRLANILVRRVGVLHRLDPGHRARRHRPRADQADSPRRLRPSRCRHSDRDRDPAGEFDRRSIRAAFALSLCGTTIPIRATAYLGRGCLRSTGMGSVNKVHMALLSRMLVLGPLDESCRRIRDVVISISIVHQQPRILGLAANWATSRSIFILILRVAAMIPTFPHAVVNGVRSPTRPQPHLTGCLPRLRTPLTAAPQSGSQASPWNYQHSTTYTYADTGDFLGPGDPVPGRLRPVTRAGARQPKSPFGRGERGPTCSTIFCLTIGAWMCQSSQRTESTGAPGGILMRKSPRYDAYHTNIAQVATELGRRDRPSTSPSQSRVSLAPAAICCCTQSWCCCGSH

SEQ ID NO: 204 - protein, 482 aa, Mycobacterium leprae
  hypothetical: YES
RAWRSGTLTGGEEVVVSRRVHRAGTIILAALTLASVVLACGAGGDQLVISFYTPASEDATFTEVARRCTEQFDGRFAIQHVSLPRSPDEQRLQLARRLTGKDRSLDVMAMDVVWTAEFAEAGWTLPLSEDPAGLAEPDAIVDTLPGPLATATWKRKLYAAPVTTNTQLLWYRTDLVDQPPGDWNGMVAEAARLHAAGEPSWIAVQANQGEGLVVWFNTLLASAGGQVLSEDGRHVTLTDTPEHRAATVRALRIIKAVATVPGADPSITRTDEATARLAVEQGKAALEVNWPFVLASMLENAVKGGVAFLPLDRISELAGSINNVGTFVPNDEQFRIAYQATRNVFGFAPYPSVSRSEPAKVTIGGLNLAVASTSRHKAEAFEAVRCLRSEQSQQYLSIEGGLPAVRASLYSDPAFQDKYPMYTIIRQQLTDAAVRPVTPAYQAVSIRLSAALNPITDIDPEPMADRLAAQVQKAIDGKGLLP

SEQ ID NO: 205 - protein, 98 aa, Mycobacterium leprae
  hypothetical: YES
TCSTLDPVLKIDQPLQIVIDDDIFRAHVGEKFSVALKTPLDAQRAFSVPYTPGVAQVSHAIAANRALAVCYTWVNRFRRKRWKRCNRVRVISDPRRCC

SEQ ID NO: 206 - protein, 302 aa, Mycobacterium leprae
  hypothetical: YES
LLQPDQQRACVSWCLLRSAGRRNESDHRKDDGGRCRGDFLCCQRRLHSRPDCSEPIELPRWRSGRLGNRSVRRRGMRVGRLAALLLAGVGVFVAGGCATDRGDRHPELVVGSKPDSESTLLAAIYVAALRSYGFGARGETGADPMAMLDSGGFTVVPGFTGKVLQILQPRAAVLSAARVYRAMVSALPEGIAAGDYTTAAEDKPTLVVTPDTAKAWSGSDLSLVLSHCNELVVGIVAGTHTPSAVGSCRLPAAREFPDYPTMFAALRAGQLTAGWTTTANPDLPADLIVLTDGKATLIQAEN

SEQ ID NO: 207 - protein, 121 aa, Mycobacterium leprae
  hypothetical: YES
LVFANIGWGEMLVLVVVGLVALGPERFPGAIRWTLGALRQTRDYLSGVTNQLREDIGPEFDDLRGQFGELQKLRGMTPRAALTKHLLDGDDSLFTGNFDRPAAAKQQDRDHHQTPFDTDAT

SEQ ID NO: 208 - protein, 208 aa, Mycobacterium leprae
  hypothetical: YES
GSDEMFDFAALSPETNSTRMYLGPGSSPILTAAAAWVVLAKELTAAAQGLQSAVEALLTTFEGESAAALAERVTPYEKWLTQNAASAELTATQLTVAANAYETAFTMTVPPLMVFVNRAQACLLIMSNIFGQNSTAIAEKEAEYTEMWIQDATAMTSYQASVLEAVGATKANRRRCWGAGYRWHLWSLAEAAVLAASTLHYACNQELS

SEQ ID NO: 209 - protein, 396 aa, Mycobacterium leprae
  hypothetical: YES
RDSSMAEIVLEHVNKNYPNGATAVHDLSITVADGEFLILIGPSGCGKTTTLNMIAGLEDISSGELRIDGDRVNEKAPKDRDIAMVFQSYALYPHMTVRQNIAFPLMLAKVKKAEIAQKVSETAQILDLTDLLDRKPSQLSGGQRQRVAMGRAIVRHPKAFLMDEPLSNLDAKLRVRTRGEIARLQRRLGATTVYVTHDQTEAMTLGDRVVVMRSGVVQQIGTPDELYERPVNLFVAGFIGSPVMNFFPAKLTPNGLTLPLGELNLSRDVQAMIGQHPVPDRVIVGVRPEHLTDAKLIDAHQHGTVLTFKVKVDLVESLGADKYIYFTTTGCDVYSAQLDELASELEVRENQFVARVSAESKMAIGESIELAFGTAKIAVFDADSGVNLTVSAPTDA

SEQ ID NO: 210 - protein, 392 aa, Mycobacterium leprae
  hypothetical: YES
RTGQRRTHIAVLRSLSVTSGSAAPLLLPTLERILDGRAPAMVVVPAQHEPIAALRALRVGEEIDDDVALVATTSGTTGVPKGALLTAAALTASASATHDRLGGPGSWLLALPPYHIGGLQVLVRSVLAGSVPIELDISAGFDLAKLPDAVGRLGTGRRYTSLVATQLAKALTDSTATAVLAELDAVLVGGGPAPRPILDAATSAGIMVVGTYGMSETAGGCVYDGVPLDGVCIRVLVNGHVAIGGATLAKGYRNPIVPDPFAESGWFHTDDLGTVDGSGVLTVLGRADDAISTGGLTVLPGPVEAALCTHPAVSDCAVFGLTDDRLGQRVVAAVVLTDGYATPTLSMLRAHVTRRLDAMAAPRELHIVDTLPRRGIGKVDRTALVRRFAKSG

SEQ ID NO: 211 - protein, 76 aa, Mycobacterium leprae
  hypothetical: YES
SSFQPMPNNIAFSRSYIGKRCYSEQEVGVFIDLAEQERTRHIEEDVEFRNRNAELRNQDGAPQPRSCADRARNCHV

SEQ ID NO: 212 - protein, 112 aa, Mycobacterium leprae
  hypothetical: YES
QWTVSTDSTILYDVATSAKYPSAKAVPQIAVGSTATREAARRAVYVPASSRTAITMAAAALDLTSKHSSPAQTLLVRAGRFGLATRTSAAHPATLRGPDVGPEVEDATGERA

SEQ ID NO: 213 - protein, 542 aa, Mycobacterium leprae
  hypothetical: YES
CHAVCDITANRLYGAKWCARNESRFLMARSHNPRHRHRAIHKPSRIRIALTRSFMTLTSFVAVLLTGAGYWVAHRALEDITVSQALTTDDPRSTDNNINILLIGLDSRKDQQGNDLPWSILKQLHAGDSNDGGYNTNTLILVHVGADNKAVAFSIPRDDWVPFSDVPGYNHIKIKEAYGLTKQYVTQKLIDQGVTDQKELETQGREAGRAATLRIVRSLTGVSIDYFAEVNLAGFYDLTHTLGGVEVCLNHAVYDSYSGADFPAGRQRLDASEALAFVRQRHGLDNGDLDRTHRQQAFISSVMRELGDTGTFTNLDKLRSLMAVARKDVVLSAGWNEDLIQRLGTLANDVGENRTQFRTLPVVRYDNINGQAVNIIDPVAIKAEVASTIGTASPATATPSKPNPSTVVDVINAGRLTGLASEVFQTLKKHGYTAGQVRDRSSGEPTTTSIQYGAGADTDAQNVATLLSIDAPNQADPKLASGHIRVIVDTNYSLPADEDSTMDETITSQKVGTYPPYSYNTSPYPTPDQGKPIDGGGIPCVN

SEQ ID NO: 214 - protein, 91 aa, Mycobacterium leprae
  hypothetical: YES
MEAYAASKVGIQAFTHSLALEYSREGLRAVCVGPGYLPKDAAWSLFLRLMPIPSTALQSSSIGMANPAAVVGVDRHAGVLGRPRRHVHHRH

SEQ ID NO: 215 - protein, 69 aa, Mycobacterium leprae
  hypothetical: YES
RMCYPRRLAGYRTLGTGAASGIGQATVLRLLDEGATVVGAATSPADGLIKYPCSADEAAIGNQLTTIQI

SEQ ID NO: 216 - protein, 427 aa, Mycobacterium leprae
  hypothetical: YES
FDNGLPRPRESGAVNINLFLLIIVVITALAFDFTNGFHDTGNAMATSIASGALAPKVAVFFSAILNLVGAFLSTAVAATIAKDLIEADLVTLELVFAGLVGGIVWNLLTWLLGIPSSSSHALIGGIVGARIAAVGGHGVIWSGVISKVIIPAIIAALLAIVVGAVATWLVYAITRSVPAMSTDTRFRRGQIGSASLVSLAHGTNDAQKTMGVIFLALMSYGTVSKTASTPPLWVIVCCAIAIAAGTYLGGWRIIRTLGKGMVEIKPPQGMAAESSSAAVILLSAHFGYALSTTQVCTGSVLGSGLGKPGGEVRWGVAGRMATAWLVTLPLAGSVGAVTYWIVHLIGGYPGAVIGFSLLVAASVAIYIRSRKVKVDHKNVNENWEGSLTAGLDGSDEHKPHSDVGPKLSATLPRYRSSHHTVGVRNAS

SEQ ID NO: 217 - protein, 131 aa, Mycobacterium leprae
  hypothetical: YES
RSHSISRRWSLGCGSYCAVSAKAGLGRAAPCTARLSFADVELDEETHEAWKADELVSLSPTEFTLLRCVVINAGTVLNTPNILDHVWCYRFGGPVNMVESYVLYLRRQIDTREKRLLHTLCGVSNGLREQH

SEQ ID NO: 218 - protein, 498 aa, Mycobacterium leprae
  hypothetical: YES
MTSRGNHGSKTSSDKHLGDSDFVVVANRLPVDQVRLPDGTAIWKRSPGGLVTALEPLLRQRRGAWVGWPGVINDNVDLDLTIKSIVQDGLTLYPVRLNTHDVAEYYEGFSNATLWPLYHDVIVKPIYHCEWWERYVDVNRRFAETTSRTAAYGGTVWVQDYQLQLVPKMLRIMRPDLTIGFFLHIPFPPVELFMQIPWRTEIIEGLLGADLVGFHLTSGAQNFLFLSRHLLGANTSRGLVGVRSRFGEVQLKSHTVQVGAFPISIDSKEIDQATRDRNVRRRAREIRAELGNPRKILLGVDRLDYTKGIDVRLRAFAELLAEGRAKRDDTVLVQLATPSRERVESYKILRNDIERQVGHINGEYGEVGHPVVHYLHRPIPRDELIAFYVASDVMLVTPLRDGMNLVAKEYVACRNDLGGALVLSEFTGAAAELRQAYLVNPHDLEGVKDTIEAALNQLAEEARRRMRSLRRQVLAHDVDRWARSFLDALAEAPARDAT

SEQ ID NO: 219 - protein, 163 aa, Mycobacterium leprae
  hypothetical: YES
PRCGVTTCVHLALWGRATQTALRHAYAEAMATIFTKIINRELPGRFVYEDDDVVAFLTIEPMTQGHTLVVPCAEIDQWQNVDPAIFGRVIAVSQLIGKGVCRAFNAERAGVIIAGFEVPHLHIHVFPTHSLSNFSFANVDRNPSPESLDAAQDKIKAALTQLA

SEQ ID NO: 220 - protein, 424 aa, Mycobacterium leprae
  hypothetical: YES
RVVRVLVIGSGAREHALLLALSRDPQVKGLVVAPGNAGTARLAEQYDVDISSGEDIVALARDVRADMVVIGPELPLVLGVADAVRAAGIVCFGPSKDAARIEGSKAFAKEVMAAAGVRTSRSEIVNSPARLDAALDRFGPPVGDLSWVVKDDRLAAGKGVVVTSDRDVARTHAAGLLEAGHPVLLESYLDGPEVSLFCVVDGRTVLPLLPAQDFKRVGEGDTGPNTGGMGAYAPLPWLPDEVCQQALTSIVEPVAAELVQRGSPFRGLLYVGLAVTASGPAVVEFNCRFGDPETQVVLALLDSPLGQLLYAAGTGSLADFGELHWRSGAAVAVVLAAENYPRRPRVGDIVFGSEIEGVLHAGTTRRDDGVIVSSGGRVLSVVATGDDLSAARSQAYRIIGSIRLLGSHFRKDIGFSAAKGRIHI

SEQ ID NO: 221 - protein, 67 aa, Mycobacterium leprae
  hypothetical: YES
VLDIAELITQFSHFSPQPTDIALYEAKAGFAWPEPTVRALPGLAEKAVLTLQFDAPMLACDEEPLQR

SEQ ID NO: 222 - protein, 105 aa, Mycobacterium leprae
  hypothetical: YES
RCHDVVWWLSLLKSSRRAVNAERTASRERKQQSRPYPPLRSSLLRCALDHLLAQLGSCIVTGPMTGNVQRHYRVAKIIDAVHQQQQPRLELVMAVAGLVLVLKCA

SEQ ID NO: 223 - protein, 77 aa, Mycobacterium leprae
  hypothetical: YES
TIWLPGRTDRYLLSSQSTRIGMDVSAGSLNTEFADQSSGTSNAPGAAVLRDKSQCRAYRPSLRYVRVSNQPLSSSAP

SEQ ID NO: 224 - protein, 92 aa, Mycobacterium leprae
  hypothetical: YES
STASRRNRHPPAPTNGGTVYLTAPDAAGIMMSMVQSNYIGFCSGVVVPETGIPLQNRSANFLLIKDIRTLLDIASITYTQSFGALLAKTVHR

SEQ ID NO: 225 - protein, 104 aa, Mycobacterium leprae
  hypothetical: YES
VECSPNPKFSVGRWGFRRISPKIALSETSWPRPTNSGTTAAFDQQSPDYWNSDVSMINSLHILMLGKWTLCYSIFFVDAAALDLLRGRVCLNGPAQRSSNFQLI

SEQ ID NO: 226 - protein, 127 aa, Mycobacterium leprae
  hypothetical: YES
PGATEVISYHSGFAISRDGGWSGGRYAVICVSVPFAVSVHRRIYSCVWPSAAFFRVCGVGTDVDEALTGYTWLRVTSWFFAFSPSAEAGVYQASNYAVLNHANHLRNNMLTVSDTAVDISSALNQAD

SEQ ID NO: 227 - protein, 105 aa, Mycobacterium leprae
  hypothetical: YES
PPPNYAPLYEAVLPKLATTAKQDINKNTRDPTHHNHDGIDTALHAPLESEKLLQHNMLPESIIVTTTLSELEDTADKVLTGCGSSLPMSNVIHLTQQARHHSIKT

SEQ ID NO: 228 - protein, 100 aa, Mycobacterium leprae
  hypothetical: YES
PPAASLSCIGRAPACDVAMLMSRIESEASWMGLPVDALLLLAWMCNGRSHTVYSRLLALVTDAVHDAQAIYPQSHDHHGSSRRSRDSPRCTVMSAGYARC

SEQ ID NO: 229 - protein, 79 aa, Mycobacterium leprae
  hypothetical: YES
ISEPLTDGRVVGLRSKSFLDESTGSALRSLMTVKVVLSHTNIPARKTLDSGESKTLNTSEMNLCPGLGYIDSDIINLRI

SEQ ID NO: 230 - protein, 69 aa, Mycobacterium leprae
  hypothetical: YES
LWCRNLRSTTLDHPLFTGDPTTIMNAVQVSVDEVGAANVQFLIAVTHDVIEVVGGSLAGLSTDLTNRLP

SEQ ID NO: 231 - protein, 96 aa, Mycobacterium leprae
  hypothetical: YES
RLVPDSTEGRRCHLFLWRRTCMEMAAADVAWIGASVAVGNLAALIPTTEWVAAGCVSRAVGTRPECSGGIVCGYGGSPMSMQGAVGVVSLAVSHGQ

SEQ ID NO: 232 - protein, 287 aa, Mycobacterium leprae
  hypothetical: YES
SSTSLNRALTLLDRVSLAIIAILLTEGSGIKPETVHDLSESCVLMRSIYWFTGETCATVRWLRGLGLASAAVIAPKVFASMVLAEYAPSPGLRLCDESSICTAACVARGNDGSSYLLTIGHCDAYDGSVWPYGPDVPLGKRTVSENEGDRKDAAIILLDLSQGYSSGDVYSQLLRNVLSENEIQLGMLFCKVGAITGETCGTIKSMDGDVVEASVYSLSAGSGSPGFVKNVDGIVSAVGILMSSPEGDDHTTYFVPMPPLLEKRGLQSFPEVLKRLSPRLVGWGSGS

SEQ ID NO: 233 - protein, 61 aa, Mycobacterium leprae
  hypothetical: YES
VCAELIHDFWGRPQFASRGYCAVLTRSGGAPAGTGQSYGGDACEHGADFRVSPLIGPADSR

SEQ ID NO: 234 - protein, 128 aa, Mycobacterium leprae
  hypothetical: YES
QSRALVPYRRYISSRKPATNQERFNLIQKPGWTTTTGSPQYFKQTSGIALLADQKTIFEQDQTIKSLARSPRYMDPNQLRISLLFLPRRHDHQRSTQRYLIQTHRFDVLGTEPLIFAIECRDHLIVSL

SEQ ID NO: 235 - protein, 100 aa, Mycobacterium leprae
  hypothetical: YES
VVEGVDQALQEQWSGQSAIWMAETAENFQPVARCLLARAWEDRPLRSMTSRGAIPEALCGMKSPGEIADNRAQRETLISGLEGHDEVIAAFDSEYERFCA

SEQ ID NO: 236 - protein, 99 aa, Mycobacterium leprae
  hypothetical: YES
LGAGPMSLSSMVVCLSGLGPQVLDQFGISAYGGTLGDVLVVLKVGTSGFEDHLSLSIENAPGEHVYSFPAINGQDGGYPLVSYVERRAVPPANHPLAGI

SEQ ID NO: 237 - protein, 66 aa, Mycobacterium leprae
  hypothetical: YES
SVTAAEQTPLPGAVWVNIAIFYDSVLGRCHASARYEVCSVAAGCLIHLAIAAEHGFADCGAYLSHH

SEQ ID NO: 238 - protein, 69 aa, Mycobacterium leprae
  hypothetical: YES
SSYTGNGPDTDRNFAASGQVILPTSTFERAHSIGGFTASYRILDAMLSATSPQTVYTVLSGALVMSRGF

SEQ ID NO: 239 - protein, 77 aa, Mycobacterium leprae
  hypothetical: YES
SRCAPLFDTIGQQTFVVSDQPHTVTLVKLSGNFLLTSTIEAVGEAVALVAKAVVDKLQLTSSPQRCSPCWRIRPTAG

SEQ ID NO: 240 - protein, 118 aa, Mycobacterium leprae
  hypothetical: YES
SSRRGRRAGRQGSSRQAAVDILASTLFTVLAYQTYGGLIALQEFEPAGFVAKLSLKDGRPVFTSASDLQMPLPGASLLHGRLLSLAATSNRHLDWSAVTTLTYRDTGTASTPDSHHPT

SEQ ID NO: 241 - protein, 79 aa, Mycobacterium leprae
  hypothetical: YES
EMTRAVSAWVAKRVNFASHRKEGRTIASVHDRYDMERMAIRVVADTLGNTIPETGYERLCRSDIDNDGSAVASEQILPN

SEQ ID NO: 242 - protein, 86 aa, Mycobacterium leprae
  hypothetical: YES
AIGLDSVARINRVFNLATIRQRVQSFTVVEHLGPTTWLPTWPEWRQKSCGSRALLSCVCGGELFGWFHRWWVKWLFLRFMTGRYVR

SEQ ID NO: 243 - protein, 106 aa, Mycobacterium leprae
  hypothetical: YES
SPHGWRKERLLSPWFNYEATLKILLFSTLAGAALPGLFALGIRLQVNDAGDASTNNATPHRKPILVTLAWVIYALVLMVVILGVLYIVSRDFIAHHTHYPFLGIKP

SEQ ID NO: 244 - protein, 112 aa, Mycobacterium leprae
  hypothetical: YES
ALIVPTAQNCSKVNRFLTSIVSWLRAGYPEGIPATDTFAVLALLARRLTNDEVKLVARELIRRGEFDKIDIGVMISHLTDELPSPQDIERVRTRLNAKGWLLDNARDNGEPT

SEQ ID NO: 245 - protein, 150 aa, Mycobacterium leprae
  hypothetical: YES
QHYRQYVVDTKAMEILASRMLLRPTDYQRSLSFYRDQIGLAIAREYGTGTVFFAGQSLLELAGYVIQGAPDHSRGAFPGALWLQVRDIAVTQADLEGRGVSITREPRREPWGLHEMHVTDPDEITLIFVEVPANHPLRRDTRSERPRTPD

SEQ ID NO: 246 - protein, 447 aa, Mycobacterium leprae
  hypothetical: YES
NGVTMPTLASTTSSPTAMMLGMPASAADLCEFINASPSPFHVCATVAGRLLDAGYAELSEVERWPDHPGRYFIVRAGSLVAWSAGQGVKAHAPFRIVGAHTDSPNLRVKQHPDLLVAGWRVVALQPYGGAWLNSWLDRDLGVSGRLSVRSAGKGSEITDRLVRIDDPILRVPQLAIHLAEDRKSLTLDPQRHVNAVWGVGDKAGSLLEYVAERTGVAVADVLAVDLMTHDLVPSMVIGADANLLSAPRLDNQVSCYAGMEALLASVPHDCLPVLALFDHEEVGSTSDRGARSNLLSTVLERIVLAAGGGRDDYLRRLPASLLVSADMAHATHPNYPECHEPSHLIEVNAGPVLKVHPNLRYATDGRTAAAFEVACQQAGVRLQRYEHRADRPCGSTIGPLASARTGIPTVDVGAAQLAMHSARELMGAHDVAVYSAALQAFFSADLF

SEQ ID NO: 247 - protein, 65 aa, Mycobacterium leprae
  hypothetical: YES
ILRPGDRGIKSAWASWSSMKAIYTARLPGCPLHHLTSKEFELLEYLAQLAGRVFTPAQLLHEVVG

SEQ ID NO: 248 - protein, 546 aa, Mycobacterium leprae
  hypothetical: YES
GGVSMSKIVSCEDDRPVRRTLEPIIVTRQGKVARLESSLTPHEAQIEDLIFLRKALNRADIPFLFIRNHKNRPVLAINIKLRPAVERALVTACASEPMYAKTIDERGLSPVLVAKGQLSQSIDPRIVRLYRRRIAPGGFRFGSRFGVELQFWSFEETLIRCPVENSLTRKVLPRKEVTPATIKLYGYKWHTIEGMFTPHASDVTFDIDLVFSWVDGSDPEFRARRAAEMSHHVVGEGDDADARIRQIDELKYALRSVNMFAPWIRRIFIATDSIPPSWLADHPMITIVPAEDHFSDRSALPTYNSHAVESQLHRIPDLSEHFLYSNDDMFFGRPLKASMFFSPGGVTRFIEAKTRIGLGTNDPTRSGFENAARVNRQLLLRRFGQLITRHLEHTTVPLRKSVLFEMEQEFPEEFARTQESVFRSGTDISVTNSLYHYYALITGRAVQQEKAKVLYVDTTSYTGLNLLPELRKRRNYDFFCLNDGSFPEVPATERAERVVSFLERYFPIPAPWEKVATDFNRQDFASPTVSAPLEDGQTANPAQTAR

SEQ ID NO: 249 - protein, 325 aa, Mycobacterium leprae
  hypothetical: YES
SWKGLAPSVHRLRAAEHPRPDYVLLHISDTHLISDGSLYGAVDADSRLGELLEQLKHSQLRPDAIIFTGDLADRGEPEAYRKLRCLVESFATELDAELFWVMGNHDNRVALRTLLLDEAPSMAPLDGVRRVDGLRVITLDTSVPGRHYGEISASQLDWLADELTTSAPDGTILALHHPPIPSVLDMAVTVELRDQASLGRVLKGSDIRAILAGHLHYSTNATFVGIPVSVASATCYTQDLTVVAGGARGRDGAQGCNLVHVYQDTVVHSVIPLGIGNMVGTFVSPAQARRDIAESGLFIEPSGRDSLFAHPPMVLTPSVTQSLGD

SEQ ID NO: 250 - protein, 397 aa, Mycobacterium leprae
  hypothetical: YES
PLRIGPIELTSPVVLAPMAGVTNVTFRTLCREFGSTRGNLLRPAPPHLRSPLEQSQVGTISGLYVCEMVTARALVERNAVTIHMTTFAPDESPRSLQLYTVDPATTYTAAKMVADEGLADHIDMNFGCPMPKVTRRGGGAALPYKRRLFGQIVAAAVRATEGTKIPVTVKFRIGIDDEHHTHLDAGRIAEAEGAAAVALHARTAAQRYSGTADWAQIAQLKQQVRTIPVLGNGDIYDASDALAMMAVTGCDGVVIGRGCLGRPWLFAELSAAFTGRPAPAPPTLGEVAEIVRRHGKLLVAHFGEDKGMRDIRKHIAWYLHGFPAGSELRNALALVKTLDELDCLLNRLDGAVPFPDAAIGPRGRQGSPAWVALPDSWLTDPDDCTVPIGADIMESGG

SEQ ID NO: 251 - protein, 432 aa, Mycobacterium leprae
  hypothetical: YES
PGSMTERKPSFMQYSPVLFTPIAMFLGSCGAYFPGDQATLRSASGAGVRRKCAEKARSVNHDKVCRAFAMVLTTAVTAGVLSACGSDVNRGHTATTSISGKSADTAACGGKRTMTAEGSTAQQNAIALFNQIWGKLCPDKTVSYNPTGSGAGREQFIAGRIDFAGSDSPLLADQLGPAAKRCKGNPAWDLPLVFGPVALVYNLPGVQMLTVNSDVLAKIFSGVITTWNDGILAALNPGVVLPNLRIMPIYRADASGTTDNLQKYLTTDAPQSWAKGVGAEFQGGVGEGVQKSAGVIQAVQTTPGAFGYVEKSFADRAGLPFAQIDTGSGGVPLTDDTARNGINAANFVSVGNDLVLDLNAMYSTEQSNAYPLVLATYEIVCSKGYDPDTFAAIKSFLTVAANDGQAGLAAVGYVPLPDTIKKRLVSAINAMQ

SEQ ID NO: 252 - protein, 238 aa, Mycobacterium leprae
  hypothetical: YES
TWFRHRFRSRERRLNHMRTAYHEQLSELSERLSEMCGLAGIAMERATQALLQADLMLAEQVITDHEKIATRSARAEESAFVLLALQAPVAGDLRAIVSAIQMVAAIDRMGALALHVAKTARRRHPQHVLPEEVNGYFAEIGRVAVELGNGAQEVVLSRDPEKAAQIREKDDAMDELHRHLFSVLMDREWKHGVAAAVDVTLLGRFYERFADHAVEVARRVIFQATGSFPEDDTVPGSR

SEQ ID NO: 253 - protein, 200 aa, Mycobacterium leprae
  hypothetical: YES
FVVGGGAYHVIVGTLLQGLICTAISMPIVFMVGIYLVEYGSGTTLAHASYIHDGYPKCSILDRGGTVLIYVLCVATLGLVCAKFMMALVLLMLPVDRLGYRENAANRSDGSARGQLHSKGSEGKKIAIIVIPKSLSGIVTEIMLVLARVMGEMAPLLILVGYSQEINFGIFRGFIGSLPGMMCDQTSADVDNNTVNTDRL

SEQ ID NO: 254 - protein, 273 aa, Mycobacterium leprae
  hypothetical: YES
PRKCSSLRNCRQENQVAKRLDLKGVNIYYGSFQAVLDVSLAVLPRSVTAFIGASGCGKTTVLRTLNRMHEVVPGARVEGTVLLDDEDIYAPGIDPVGVRRAIGMVFQRPNPFPAMSIRDNVVAGLKLQGVRNRKVLDDTAEYFLRGTNLWDEVKDRLDKPGGGLSGGQQQRLCIARAIAVQPDVLLMDEPCSSLDPISTMAIEELIGELKQEYTIVIVTHNMQQAARVSDQTAFFNLEAVGRPGRLVEIDDTEKIFSNPTEKATEDYISGRFG

SEQ ID NO: 255 - protein, 168 aa, Mycobacterium leprae
  hypothetical: YES
AYAGSVVSMPLSKLPIALISSWAAAELGRPEISQAVVEGSGVRIVVIAVVGALLLCRAIPALRRDKENFFSYSGTWVIADISVMNFGIFDLLQVTVLVSLFALILVMSTASGVALFITQYAPRRVVGAVAYSVDLLAVVPSIICGVWGWYVLAPQLCPITTWLDRTLV

SEQ ID NO: 256 - protein, 557 aa, Mycobacterium leprae
  hypothetical: YES
TVCLAVGVGVRAPKHVPQIRRLGRAGRRLRCVTNCALGSCPIVTVQQPGRDFSSPREECGVFGVWAPGELVAKLTYFGLYALQHRGQEAAGIAVADGSQVLVFKDLGLVSQVFDEQTLAAMEGHVAIGHCRYSTTGDTTWENAQPVFRNIAAGSGVALGHNGNLVNTAELAARARDAGLIAKRCPAPATTDSDILGALLAHGAADSTLEQAALELLPTVRGAFCLTFMDENTLYACRDPYGVRPLSLGRLDRGWVVASETAGLDIVGASFVRDIEPGELLAIDADGVRSTRFANPTPKGCVFEYVYLARPDSTLAGRSVHGTRVEIGRRLARECPVEADLVIGVPESGTPAAVGYAQESGISYGQGLMKNAYVGRTFIQPSQTIRQLGIRLKLNPLKEVIRGKRLIVVDDSVVRGNTQRALVRMLREAGAVELHVRIASPPVKWPCFYGIDFPSPAELIANVVADEEEMLEAVRQGIGADTLGYISLRGMIAASEQPASRLCYACFDGRYPIELPSEAMLGKNVIEHMLANAARGAGLRDLAADQVPVDADENCVWR

SEQ ID NO: 257 - protein, 197 aa, Mycobacterium leprae
  hypothetical: YES
VTTGSLYRDDGSRKKPRSQLGNHGITYASTGVDIEAGDRSVELFKPMAVKAIRTEVLGGLGGFAGLFALRSGYREPVLAASTDGVGTKLAVAQAMDKHATVGLDLVAMVVDDLVVCGAEPLFLQDYIAVGRTVPERLSAIVDGIAEGCMLAGCALLGGETAEHPGLMEVDHYDIAATGVGVVEADDTWGQIVSNPVT

SEQ ID NO: 258 - protein, 766 aa, Mycobacterium leprae
  hypothetical: YES
LRDLSGLGRLTRVIDTVEYAATTPDQPQPFAELGLREDEYQRVREILGRRPTDTELAMYSVMWSEHCSYKSSKVHLRYFGETTTEEMRTGMLAGIGENAGVVDIGDGWAVTFKVESHNHPSYVEPYQGAATGVGGIVRDIMAMGARPVAVMDQLRFGAADALDTRRVLDGVVRGIGGYGNSLGLPNIGGETVFDSCYDGNPLVNALCVGVLRQEDLHLAFASGAGNKIILFGACTGLDGIGGVSVLASDTFDAEGARKKLPSVQVGDPFMEKVLIECCLELYAGGLVIGIQDLGGAGLSCATSELASAGDVGMAIQLDTVPRRAKDMTPAEVFCSESQERMCAVVAPENVDAFLAVCRKWEVLATVIGEVTDGDRLRITWHGETVVDVPPRTVAHEGPVYQRPVSRPESQEALNADSSKGLPRPVSGDELRATLLALLGSPHLCSRAFITEQYDRYVRGNTVLAEHADAGVLRIDESTGRGIALSTDASGRYTRLDPYAGAQLALAEAYRNVAVTGATPVAVTNCLNFGSPEDPGVMWQFAQAVRGLADGCAALKIPVTGGNVSFYNQTGAVAILPTPVVGVLGVLDNVARRIHTSLGTEPGEILMLLGDTYDEFDGSVWAQVMAGHLGGLPPMVDLAREKLLAEVLSSASRDELVSAAHDLSEGGLAQAIVESALAGETGCRIALPEDADPFVMLFSESAGRVLVAVPRPEESRFRSMCEARGLPAMRIGVVDQGSDSIEVRGQFTVSLAELRMTFEAVLPRFFG

SEQ ID NO: 259 - protein, 213 aa, Mycobacterium leprae
  hypothetical: YES
DRRTPWSDGSRPLRHRGDRRRCCGSRRYLGPDRVKPGDVIIALRSSGLHSNGYSLARSVLLEIDRMNLAGYVEEFGRTLGEELLEPTRIYAKDCLALAAETHVRTFCHVTGGGLAGNLQRVIPHGLVAEVDRGTWTPAPVFAMIAQRGRVAREEMEKTFNMGVGMIAVVAPEDTDRALAILTARHLDCWVLGTVCKGSKVGPRAKLVGQHPRF

SEQ ID NO: 260 - protein, 345 aa, Mycobacterium leprae
  hypothetical: YES
TQITGGAMSAELTDLQLLHELEPVVEKYMNRHERLHKNWNPHDYIPWSDGKNFYALGGQDWDPEQSQLSDVAQVAMVQNLVTEDNLPSYHREIAMTMGMDGAWGQWVNRWTAEENRHGIALRDYLVVTRAVDPVELEKLRIEVVNRGFSPGQNHQGGLFADTLFDSILYVTFQELATRVSHRNTGKACNETIADQLLAKISSDENLHMIFYRDVSEAGIELAPNLAIKALHKILHNFKMPGFLVPEFRRKAVIIAVGGVYDIRIHLDEVVMPVLKKWRILEREDFSGEGTRLRDEIGEHLTELEAACDKFEVSKQRYIEREARRTEKITARKVLSTEGTLRMSGR

SEQ ID NO: 261 - protein, 174 aa, Mycobacterium leprae
  hypothetical: YES
AIMMRASDDAEQSDDDDVGARPLQVGGNTGRATLMMTAIVATITVGMLTAFTGRWLTRHSGNVHEICSGPGQGTGTDTADLGLSRTGPTIVHFSAPWCGPCDRVRRVVYQVCKDLPDVAHIEIDLDTNPAAVRRFSVLSLPTTLIFDTDGQQRYRTSGVPKAFDLLSTLEPLLA

SEQ ID NO: 262 - protein, 324 aa, Mycobacterium leprae
  hypothetical: YES
WPLSSTQRSASVWAVSSTRLWCGFDALPLHVTVTLVDHPKVSERTLTMARSDVLVSADWAESNLDSANIVFVEVDEDTSTYDGDHIAGAIKLDWRADLQDPIKRDFIDTQQFSKLLGDRGISNDNTVILYGGNNNWFAAYAYWYFKLYRHDKVKLLDGGRKKWELDGRPLSTDTVTRPATSYAAAAPDNTIRAFRDEVIASIKIKNLVDVRSPDEFSGKLLAPAHLPQEQSQRPGHIPSAINIPWSKAANEDGTFKSDEQLAKLYADAGLDRLKETIVYCRIGERSSHTWFVLRELLGYQNVKNYDGSWTEYGSLVGVPIELGS

SEQ ID NO: 263 - protein, 71 aa, Mycobacterium leprae
  hypothetical: YES
TTVHSFQFLDKIYLLFFVDCTENPYDAIVISTSAIGEEDPDFASSCYVNAQKLSSRHTVVGVPVSHQYNNR

SEQ ID NO: 264 - protein, 67 aa, M. leprae gene sequence
  hypothetical: YES
LRICSDAWNRLFGGSRPTELHPLVQNWPDYSTPAQRTYGDMLFDVRADTMDVCLELACHVTESQWQV

SEQ ID NO: 265 - protein, 153 aa, Mycobacterium leprae
  hypothetical: YES
NGEGDALMNSQRSAALAGMPNIMAVGDDVVDARVGIVTPFQLQSILAPVTSTAIFLGVTIDISGEATVHDTLSERSGLICVIASRSYQPLITGDSESVLTPGIDCLAALGPQNCIHSSRTGQTTAHLLSEHTETCCLTFVPIRWTYVWSWPAT

SEQ ID NO: 266 - protein, 79 aa, Mycobacterium leprae
  hypothetical: YES
KNNGWRNWVTIYPNAAPDVWVAISQAMTTAHTINHQQRYLDDVLLAATGFGNMGGIDIRTERVIPGAWYPRSGHLQPAA

SEQ ID NO: 267 - protein, 79 aa, Mycobacterium leprae
  hypothetical: YES
LTRRRPPRRSIRLFDTSTEIIEKVDPVKLNLTLNAAAEAPSRLGDKVGATLIDGNVLLDDVNLQLPQNQAKKTTAGGTG

SEQ ID NO: 268 - protein, 379 aa, Mycobacterium leprae
  hypothetical: YES
GGGTSRLRGRATHVNAVLAPDPGPDAGAIWHFGDPLGEQRSAETDAVLVDRSHRATLTLIGSDRQTWLHSISTQHVSALPDGASTQNLSLDSQGRVEDHWIQTELGGTTYLDTEPWRGEPLLEYLRKMVFWSEVTPGSADMAMLSLLGPRLTEQAVHNALYLDALPDESTAVPLTAGSFVRRIPGAPAGQIELDLLVPRRESADWQSRLAGVGVRSAGMWAYEAHRVAALRPRLGVDTDQRTIPHEVGWIGGPGEGAVHLDKGCYRGQETVARVQNLGKPPRMLVLLHLDGSVERTSTGDAVLANSGAVGRLGTVVEHVDLGPVALALLKRGLPTDTELTIELEGPQDGSVAAVIDPDSLPAADEIGVGRLAIERLRGR

SEQ ID NO: 269 - protein, 70 aa, Mycobacterium leprae
  hypothetical: YES
ETALFISWIRKARDALLFDVDGHLLSCLTVLVGNIHSAGLDIEHRIKHALAGGPSGTAGHVDLSNCEGRL

SEQ ID NO: 270 - protein, 79 aa, Mycobacterium leprae
  hypothetical: YES
TRPSSWAQPPEPCQTWSASTRSNLPSKHVSMLAATTRQYAASSCTLRDNTLRVYEAAACSGQTPMPATEQGKGLSLDVQ

SEQ ID NO: 271 - protein, 249 aa, Mycobacterium leprae
  hypothetical: YES
GGGRPPQVGGTSTRLRGRAVHVTSDEVRDGAGSPADSSKGNKCTAAGMFQAAKRSTVSAARNIPAFDDLPVPSDTANLREGANLNSTLLALLPLVGVWRGEGEGRGPNGDYHFGQQIVVSHDGGNYLNWEARSWRLNDAGEYQETSLRETGFWRFVSDPYDPTESQAIELLLAHSAGYVELFYGRPRNASSWELVTDALACSKSGVLVGGAKRLYGIVEGGDLAYVEERVDADGGLVPNLSARLYRFAG

SEQ ID NO: 272 - protein, 152 aa, Mycobacterium leprae
  hypothetical: YES
KRQSSTAESVNDHHTPGSCCASYSDIKTSRTTTAVGQNTAPWWVSQSNWEADMCSEPKQRLALPANVNLEKETVITGRVVDRKGQAVGGAFVRLLDSSNEFTAEVVTSATGDFRFFAAPGSWTLRALSSVGNGDAMMSPSGTGIHKVDVKIT

SEQ ID NO: 273 - protein, 194 aa, Mycobacterium leprae
  hypothetical: YES
SSQALSRRTRSLPWPVSHFVRATRATGVPRSRTVTINNTTTGVEVVDVRGPRFAAWVTAAVLQTVLIISVVSPLAAALLLVLQAVVFATGTLGGPRRHPYGRVFAALVAPRLGPVKEREPVPPLKFAQLLGFVFVVCGVTGFAAGAFLVGVIATAAALVAAFLNAAFGICLGCQLYPVVVWFRRTAAPRNRNPG

SEQ ID NO: 274 - protein, 71 aa, Mycobacterium leprae
  hypothetical: YES
LACHWVSWLTCQPASSPGSPSVAQSICAKSRVVPVAAEVAKLFRAALGAYRGLSPTLSVQHVQQEYLGVEQ

SEQ ID NO: 275 - protein, 289 aa, Mycobacterium leprae
  hypothetical: YES
SCRWSEMVKDATCIKVRHNMRMRKVLTSVIATVVTMAVLVVGVLGIDYGTSIYAEYLLSVNVRNAANLGSDPFVAILAFPFIPQAMRDHYTELEIKANAVDHAMVGKASLEATMYSIDLTYASWLIKPDAKLPVDRLESRIIIDSMHLGQYLGISDLMVEAPHRETNNATGGTTESGISSGHGLVLSGTPKSANFDHRVSVLVDLSIAPEDQATLVFTPTGIATGPDTANQPVPDDKRNPVLRAFSARMSDQRLPFGVAPTSEGARGSDVIIEGITQGVTITLDGFKQS

SEQ ID NO: 276 - protein, 313 aa, Mycobacterium leprae
  hypothetical: YES
SVMVLNWRFALSADEQRLVREIISAATEFDEVSPVGEQVLRELGYDRTEHLLVTDSRPYAPIIGYLNLSSPRDAGVAMAELVVHPRERRRGVGAAMVRAALAKTGGRNRFWAHGTLASARATASVLGLVPVRELVQMQRSLRTIPDPMVPDQLGVWVRTYVGTVDDAELLRVNNAAFAGHPEQGGWTATQLAERRSEPWFDPAGLFLAFGDSSSNQPGKLLGFHWTKVHAAHPGLGEVYVLGVDPSAQGRGLGQMLTSIGIASLAQRLVGPSAEPTVMLYVESDNVAAARTYERLGFTTYSVDTAYALARIDD

SEQ ID NO: 277 - protein, 234 aa, Mycobacterium leprae
  hypothetical: YES
NRQIRTHLQREEVCRKTPTQDYELGAVLDYRERKVVNRATVLNYVRARKVTTDFTGDYRRIKRQQLSLSSLLSSTILSDTLFNLNKLNNLVNMFISKSYVDNVKTKDLAQLGMSLQGMATGHITFVTVPTGVTDGNGNEPPRTADMRVLFDAIINDDPLPLENNQNTQSSGMTPTTTPTPKKAILNNPAPEVQHKQMTITSPRGMTRAGVQVNQPTKSGNHRSQQTQAGQLQLL

SEQ ID NO: 278 - protein, 65 aa, Mycobacterium leprae
  hypothetical: YES
FIDYCTGDAAKYGCHMRTPDKLKEIERSVHSTTCDWGCPAGSYKVPCSPVFEGYAKDELASRCGR

SEQ ID NO: 279 - protein, 165 aa, Mycobacterium leprae
  hypothetical: YES
QGGALTNCATGPCLCSTSPRSSTPYGIRTRATALKGRRPRPLDEGGQNRISPGYSQRSYRWSPVSLGHRGPNPQTSSVPETGILNIHAPIAQLVELRTFNPQVLGSSPSGGTDPPAIITLSDVGAFDDSAVQQLVCQWSTGVVPDLLARRAAKRRVTAISLVMLS

SEQ ID NO: 280 - protein, 100 aa, Mycobacterium leprae
  hypothetical: YES
LSRYERPPEKRKVGGSIPPLATGSELCGHCDGSYGRFSVSGFYPFAWVAAEMWSQVRSRFVATQPSLSVYEIAVDIGGASWCGSSVRSVRSAPDTRARLV

SEQ ID NO: 281 - protein, 76 aa, Mycobacterium leprae
  hypothetical: YES
VYVNPTILAGYVENRPQQPKRGEFSSRADSEGVDELLYALAADFVGRLGVSNAGCNHSTSWATRLGVLTRCIWVQI

SEQ ID NO: 282 - protein, 87 aa, Mycobacterium leprae
  hypothetical: YES
RPVTGRICIDQFSRLLISSADVSLVHGYVAISTVDSCSHIKNSIQIVPGTTIVDWAECAPTASRVLEAAFYGSSTVWSIRVWAAMRK

SEQ ID NO: 283 - protein, 488 aa, Mycobacterium leprae
  hypothetical: YES
LGLATTPGNLAHVLLASLNPSVVTATDIADAVCVDGVVLSRSGLVGAATSVAERVGGARLVAVLATPTASTVLAITGCLIAGVPVVPVPADIGVVERRHMLTDSGAQAWLGPGPSADSAPDGLPHIPVQLDARSWNRYPEPSPDATAMVIYTSGTTGPPKGVLLSRRAIAVDLDALAQAWQWTADDVLVHGLPLFHVHGLVLGLLGSLRIGNRFVHTGKPTPTAYAQACSEAGGSLYFGVPTVWSRLVADEAVARALRPARLLVSGSASLPVPVFDRLAHLTGHRPIERYGSTESLITLSTLADGERRAGWVGLPLAGVQTRLVDESGGPVPYDGETVGRLQVRSPTMFGGYLNRPEATAEAFDEDGWYRTGDVAVVDSGGMHRIVGRESVDLIKLGGYRIGAGEIEMALLGHPDVREVAVVGLPDEDLGQRIVAFVVGAEALDADELINYVAQQLSIHKRPREVRFVDALPRNAMGKVLKKQLLFEG

SEQ ID NO: 284 - protein, 277 aa, Mycobacterium leprae
  hypothetical: YES
AAGSSWRPSAADLAEREIAADWAIAVMGRCAFPAHSSTLPPRGASAMTWISTRPNHNNVPAATANGSQLGRVAPLKLTSNAMSDASAKANGHHHHGTHNRSRYRTLCGATGVPDTRSRVVCGPVSTSLAVVRLDPGLPLPSRAHDGDAGVDLYSVEDVKLAPGQRALVRTGLAVAIPFGMVGLIHPRSGLAVRVGLSIVNSPGTVDAGYRGEIKVALINLDPVEPLVVHRGDRIAQLLVQRVELVELVEVSSFDEAGLAETSRGDGGHGSSGGHASL

SEQ ID NO: 285 - protein, 401 aa, Mycobacterium leprae
  hypothetical: YES
KTRRNCLVSTFLGAPAWSLMLRSDVGYARPIVRGSTGPVAVLRSMSTRRELLESPYLAAVSGRKPCRVPVWFMRQAGRSLPEYRALRERYSMLAACFEPEVACEITLQPLRRYDVDAAILFSDIVVPLCAAGIDLDIVPDVGPVIGDPVRTATDIHAMKPLEPQAIQPIFQAISLLVAALGDVPLIGFAGAPFTLASYLVEGGPSRNHPRTKAMMLAEPASWHTLMDKLTDLTLGFLLGQIDAGVDAIQVFDSWAGTLSLSDYRQYVLPHSARIFATVAEHGVPMTHFGVGTADLLGAMSAAVRSGEKPGHQAVVGVDWRTSLTDAAARVEPCTALQGNLDPVVLLAGWPAVERVARTVVDDGRRAVVAGAAGHVFNLGHGVLPETDPGVLSELVSFIHSL

SEQ ID NO: 286 - protein, 581 aa, Mycobacterium leprae
  hypothetical: YES
RPDFCHGGRTRGADDALRGWHRRPAGCDVSGCAVRRKAWAPGRRRRGLANLVDRCCCPSGTLYRAAGQPRPGGAVSGLAGCRTCRTDCRRRRAPCRRGRRGWPRFQSRPWSVAGDRSRRAERISIVHPLAMTSRSYCVVGGGISGLTAAYRLRVATGDDVAITLFDPGDRLGGVLRTECVGGQPMDLGAEAFLLRRPEVPALLAELGLSERQRATTDARPLIYSQQRLHSLPPDTVAGIPSSATSVAGLVDDATVARIGAEAVRPLSWEPGSDPAMAELVADRFGEQAVARLVDPLLGGVYAGSAATIGLRAGAPSVAAALDCGATSLMEAVRQGLPPVAAGPVFGALDGGYQVLIDELVRRSRLQWVAATVVGLDRGTCGWTLVDDTGACWSADGVILAVPAPRLVRLLQQIAPRTVAAASRIVSASSAVVALSVPRDTTFPQNSGVLVASGERLRAKAVTLSSRKWGLQGDTQLVRLSFGKFGDQVASTASDDELLAWAVSDLAAVFDVTVDPVDVCVQRWIDAMPQYGPGHADLVAEVRAGLPPTLVVAGSHMDGIGVPACISAAGRAIEALQAEVAR

SEQ ID NO: 287 - protein, 429 aa, Mycobacterium leprae
  hypothetical: YES
MSVIAITVFIVTYALIASDRVNKTLAALTGAAIVVTLPIINSEDVFYSHETGIDWEVIFLLLSMMIIVSVLRQTGVFEYVAIWTAKRSHGSPLRILLLLVLVMALGSALLDNVTTVLLIAPVTLLVCERLTINAAPFLMAEVFASNIGGAATLVGDPPNIIIASRAGFSFNDFLIHLTPIVIIVTVVLSALLPRLFRGAFAVDPERVADIMSLNEREAIRDRWLLIKCGVVLLLVFVAFIAHPVLHTGPSLVGMLGAGILIVISKLERSDYLSSVKWETLLFFAGLFIMVGALVKTDVVNQLARATTTLTGGHELLTVVLTLGVSTLVSSIIDNIPYVATMTPIVSELVASMPDQSHTDILWWALALGADFGGNLTAVGASANVVMLEIAKSAGTPISFWEFTRKGIAVTVISIALAGIYLWLRYLVMS

SEQ ID NO: 288 - protein, 295 aa, Mycobacterium leprae
  hypothetical: YES
CDRPVTVPDNDPEQLRCVAESLATEAAAFVRCRRAEVFGTDLGAAGGGAVRAKSTPTDPVTVVDTETERLLRDRLAQLRPGDSILGEEGGGPADLTATPADTVTWVLDPIDGTVNFVYGIPAYAVSVAAQVDGVSVAGAVAEVVAGRVHSAASGLGAHVTDEYGVQVLRCSAVDDLSMALLGTGFAYSVVRRAAQAALLAQMLPVVRDVRRIGSAALDLCMVAAGQLDAYYEHEVQVWDCAAGALIAAEAGACVQLPKRNGPVGGAGLVVAAAPGIADALLAALQRFNGLAPILD

SEQ ID NO: 289 - protein, 580 aa, Mycobacterium leprae
  hypothetical: YES
RTEFCPVEQSRRVPPLQWLSAVARPIARVLTLISTPTFDIADTFGYACPNPPEVSPTEGVYVVATKTSPATGQPVKRTATKTPATPAKRSTTKAANGSAPTKRATSTASRATKSTTPPKASGASDAAKKARTSVKSVDTKAPSAQDHTTKASAAKDTLNDPEATLNTLDSDATADDLDAEPDLDVEPSEDIDIDIEAADLGLDDLEDDDVVTDIEPGETEDGEATAATKTDEASTDDDEEIVEPTEKDKASGDFVWDEDESEALRQARKDAELTASADSVRAYLKQIGKVALLNAEEEVELAKRIEAGLYATQLMTELSERGTKLPTAQRRDMMWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLETLSEREAGVVRLRFGLTDGQPRTLDEIGQVYGVTRERIRQIESKTMSKLRHPSRSQVLRDYLD

SEQ ID NO: 290 - protein, 798 aa, Mycobacterium leprae
  hypothetical: YES
NIADFLAAQLFRRLVGRRLVEHASQRGIILDIPGHNESHHLGCGQHCVGLVRHIGDQESRQAVLRKHTSSVQCARIDADCREVFGDVLGEHAMTIRLCGSWSVGDIEANYMMYSRIAGHCCRPVFVTHRRLTLPKRWLGYPFGAPTLALPEYNNGMLEQIRRPADLQHLSQQQLRDLAAEIRELLVHKVAATGGHLGPNLGVVELTLALHRVFDSPHDPIIFDTGHQAYVHKMLTGRCQDFDSLRKKAGLSGYPSRAESEHDWVESSHASTALSYADGLAKAFELAGNRNRHVVAVVGDGALTGGMCWEALNNIAATPRPVVIVVNDNGRSYAPTIGGVADHLATLRLQPAYERLLEKGRDALHSLPLIGQIAYRFMHSVKAGIKDSLSPQLLFTDLGLKYVGPVDGHDEHAVEVALRKARGFGGPVIVHVVTRKGMGYPPAEADQAEQMHTCGVMDPTTGQPTKIAAPDWTAIFSDALIGYAMKRRDIVAITAAMPGPTGLTAFGQCFPDRLFDVGIAEQHAMTSAAGLAMGRMHPVVAIYSTFLNRAFDQIMMDVALHKLPVTMVIDRAGITGSDGPSHNGMWDLSMLGIVPGMRVAAPRDAIRLREELGEALDVDDGPTAIRFPKGDVCEDIPALKRRSGVDVLAVPATGLAQDVLLVGVGVFASMALAVAKRLHNQGIGVTVIDPRWVLPVCDGVLELAHTHKLIVTLEDNGVNGGVGAAVSTALRQVEIDTPCRDVGLPQEFYDHASRSEVLADLGLTDQDVARRITGWVVAFGHCGSGDDAGQYGPRSSQTM

SEQ ID NO: 291 - protein, 526 aa, Mycobacterium leprae
  hypothetical: YES
PILPIRRCRMHTRPAISRTHTPQTEPRISHPSSPCSPSGTWLKLNTIAGVPDHLLPLSTVDIDAIDGTKNLRRTRQLRCDGSGVKCSHLARPKVSICIHRPYSEPMARQHPSPRVRELIREGARIALNPTQEWIDQLDRATFAANPAIANDPVLAKVVRRASRAHLVHWATANLRDPGAPVPAHLGPEPLTMARDLVRRGRDVLALDIYRVGQYTAWRRWMEIAFTLTSDPQELREILNVSAQSINEYVAATLEAIATHMQLERDELTRSTHAERLEVVDLILEGAPVTQERAEARLGYRLGLTHTAAVIWSDDLDGDHGYLDQAAEAFSHVVESTQQLIVVASAATRWVWLADALALDVPEVQKALLNLSKARVAIGTSSAGIEGFRRSHLEALTAQRTLARLKSHQQVAFFADVQLVSLITQNPEDAKEFITSTLGDFESASPALQQTLLTFINEQCNASRAAKRLFTHRNTLLRRIESAEKLLPRPLDHTSVHIAVALEALQWRGDQTNTSGPRAGRNDGVPA

SEQ ID NO: 292 - protein, 345 aa, Mycobacterium leprae
  hypothetical: YES
DDSRTGTLKEDPSLKQTTEQADWEGVMAEATTNRVDSDLDAQSPAADLVRVYLNGIGKTALLNAADEVELAKRIEAGLYAEHLLQTRKRFGEGRKRALAAVARDGAAARRHLLEANLRLVVSLAKRYTGRGMPLLDLIQEGNLGLIRAMEKFDYTKGFKFSTYATWWIRQAITRGMADQSRTIRLPVHLVEQVNKLARIKREMHQNLGREATDEELAAESGIPIEKINDLLEHSRDPVSLDMPVGSEEEAPLGDFIEDAEAMSAENAVIAELLHTDIRSVLATLDEREHQVIRLRFGLDDGQPRTLDQIGKLFGLSRERVRQIERDVMCKLRNGERADRLRSYAS

SEQ ID NO: 293 - protein, 88 aa, Mycobacterium leprae
  hypothetical: YES
KYKVVVKYDGYHHRTNSPVSTSAIRTSGASSKNSAVIIIRMIIEGKPEDVAQHIHASELPLHLNGCTHHASNHRYGLNLTTQTLNSNG

SEQ ID NO: 294 - protein, 61 aa, Mycobacterium leprae
  hypothetical: YES
PHPPIGVITRNQRVKSDEITRIVGLLVTTCAKTAFDLAVQLPTGKAVTRLDTLMQATPYSS

SEQ ID NO: 295 - protein, 115 aa, Mycobacterium leprae
  hypothetical: YES
CDRSLTVRLGWVGVGIVREITSKGGARVFAGCFGGCTDSTPTMLAKTLNRVTELVLLSYAVSSGPSGFKGRQGERCGQLRTEIDMCAGQEVQSRTNCGGVGPKPIPTGPKDAGVL

SEQ ID NO: 296 - protein, 73 aa, Mycobacterium leprae
  hypothetical: YES
VRHLQLLQALREDLHTRVHPDAITAHRDRQHLSPVFRSEPFNSVRVLVRTDGSDDWKCEVAVPRFDAHRLSRD

SEQ ID NO: 297 - protein, 117 aa, Mycobacterium leprae
  hypothetical: YES
GRDGPGVCLTPVTEMSCQHKRLIVGRVQGESPSLQHRPVLRNLELCHHVTLRSPASAAAAMARLAWFWTVRLSYNRTHILVQYLGHVLRPIVVNFGLIHHNKTSGPALPALLGRSPI

SEQ ID NO: 298 - protein, 65 aa, Mycobacterium leprae
  hypothetical: YES
TGRTGPDAPHDPAHRRIMQQRKKLAPVTVQRGSELGNDLIDRALPDRGLRGHLGDLPTQISFMIR

SEQ ID NO: 299 - protein, 166 aa, Mycobacterium leprae
  hypothetical: YES
HCDIVPPHSPHAETEAGHAGVDLVLGTVGKLSTAPNRGTTDTFDDNSRPVLITTAAPSYEEERRTRVRKYMTLMAFRIPALMLTTVAYSAWHNGLISLLIVAASVPLPWMAVLIANDRPLRRTEEPRRFDSRRRRTPLLLTTEQPAFKSLRRPPPKPTSLATDSRS

SEQ ID NO: 300 - protein, 119 aa, Mycobacterium leprae
  hypothetical: YES
FPHCTQYKINSGVSGFCFSVGRVRRHNVTMLGRHNVTMLGMQTQTIEHTYTDEHVDDGTGSDTPKYFHYVKKDKIVESAVMGSHVVALCGEVFPVTRAAKPGSPVCSDCKRVYDMLKKG

SEQ ID NO: 301 - protein, 340 aa, Mycobacterium leprae
  hypothetical: YES
LATQAVTGNSMSGQVYKPTRQHIWRISLRTLSKSWDDSIFSESAQAAFWSALSLPPLVLGMLGSLAYVAPLFGEDTLPTIERRVISMAHSFFSPSVVNEIIEPTISDVNNGARGEVVSLGFLISLWAGSSAISAFVDAVVKAHDQTLLRHPVKQRLFALFLYIAMLAFVVATAPLVVVGPRKVTKLIPHSWANMLHLGYYPAVIVSLLVAVMILYRVALPIPLPTHRLVFGAILATAVFVITTLGLRIYLKWITGTGYTYGALTTPIAFLLFAFFGGFAIMLGAEFNASIQEKFPAPKTHTHRLHNWLTSRLHTDPGRNTVTTQTTQHRSGRAAELINPS

SEQ ID NO: 302 - protein, 116 aa, Mycobacterium leprae
  hypothetical: YES
PQQILINSLSNGSLMALGNILRSKSSTIWCPSASPYADFEMVSLSKNSSTKTFARQFASLNSQGTHVTTPKRRIDHEYLLSPAVSVIHETIGRLNPAMNDQARNRQARIPATYQHR

SEQ ID NO: 303 - protein, 141 aa, Mycobacterium leprae
  hypothetical: YES
ALIFKSHHYPEITVLPGQVSLAASRLPNFLCQQIRITCLLSKLFRELIVAGSAPQATVIACRSAATTSHPDRISNLVVDYSRAVQVGPHVAASEVTSARPAGDMADQMGEVLRRIKSALKQMGSALTDGVHTRIHVTDILR

SEQ ID NO: 304 - protein, 461 aa, Mycobacterium leprae
  hypothetical: YES
HARRGRSPPSAPDRQQLQQPRRPLTRHQPELRPTPRKPGCRRQSSPCHRWGQAPRLPCLQAWRSDRRAHPPPPQGSSHRAVVERADHATSVLSRCQRQSPDRSGYSSPVPRRRLRRPGQYQTPQLGDIARTRRPQWPVIRLRSAAARDRCQVLSLAYRITVAGRCQTVSPHHRQAKVSEQPSLAKEIAITSTDATADTPRTSPPSDTAGTTSRHRGFGIDIGGSSIKGGIVDLDIGQLIGDRIKLLTPQPATPLAVAKTIAEVVNAFGWTAPLGVTYPGVVTQGVVRTAANVDDSWIGTNARDIISAELNSQEVTILNDADAAGLAEGRYGAGKNNSGLIVLLTFGTGIGSAVIHNGKLIPNTEFGHLEVDGKEAEQRAASSVKDKYKWSYRTWAKQVTRVLVAIENAMCPDLFIAGGGISRKADRWIPLLENRTPMVAAALQNTAGIVGAAMASTADVTH

SEQ ID NO: 305 - protein, 219 aa, Mycobacterium leprae
  hypothetical: YES
SATVVTQITEGTAFDKHGRPFRRRNARPAIFVVVFLVIVAGVSWTIALTRPAKVREPEVCNPPTQSTGSVPTQLGKQVPRTEMTDVTPAKLSDTKVHVLNASGRDGQAADIAGALRDLGFAQPTAANDPMYADTLLNCQGQLRFGTAGQATVAAVWLVAPCTELLHDNRTDDSVDLALGTDFTALAHNDDIDAVLASLRPGATEPSDPALLQKIHANSC

SEQ ID NO: 306 - protein, 194 aa, Mycobacterium leprae
  hypothetical: YES
RSTPASPSWARLGSGSPGSRRTTARLVDTGPQTTLDRVSGTPVAPHNVRYRERLWVPWWWWPLAFALASLIAFEVNLSGATLPSWLPFAVAAGTLLWLGRVEIQVIADAPLGGSVELWAGNAHLPITAIAQSAAISRSAKSAALGRQLDPAAYVLHRAWVGPMILVVLDDPDDPTPYWLVSCRHPERVLSALRS

SEQ ID NO: 307 - protein, 104 aa, Mycobacterium leprae
  hypothetical: YES
RGLDMPTDYDAPRRTETDNVPEDSLEELKARRNEAASAVVDVDESESAESFELPGADLSGEELSVRVIPKQADEFTCSSCFLVQHRSRLASEKNGVMICTDCTA

SEQ ID NO: 308 - protein, 301 aa, Mycobacterium leprae
  hypothetical: YES
GLVVRRSWAGRDIPWRWRSRFLRRTCEFVTADDDAERSDEDGAAVMATFGKRTGKDGASRTLTEPADPEATELPAASEPDSEEVDELEGPFDIDDFEDPAVAVLARLDLGSVLIPLPEGSQLQVELTDVGVPNAVWVVTANGRFTITAYAAPKTGGLWREVAGELADSLRNDSAKVTVKDGPWGREVVGTNTGVVRFIGVDGYRWMIRCVVNGPLETIDVLSEEARAALADTVVRRGDTPLPVRTPLPVQLPEQMAEQLREAAVAQQSAQHADARQQSRELAPRRGAAGSAMQQLHNTTGG

SEQ ID NO: 309 - protein, 239 aa, Mycobacterium leprae
  hypothetical: YES
TAGHYQGVAVDLRNVTTVLLPGTGSDDDYVYRAFSGPLHRVGAAVLTPPPQPNRLIDGYLSALDDAARAGPIGVGGVSIGAAVAAAWALAHPERAVAVLAALPAWNGAPESAPAALAARYSASHLRRDGLAATTLQMQASSPPWLADELARSWCGQWPLLPDAMEEAAAYIAPSCAELARLATPLGVAAAVDDPIHPLQVGVDWVTAAPHAALQTVTLNQIGTNAAALGTACLAALALT

SEQ ID NO: 310 - protein, 77 aa, Mycobacterium leprae
  hypothetical: YES
CADGVRAELFNGSDTMFNGSDTKELRWCAWGNVGYTRYRLGVDAAGAIIGRASSTTGARLQERTIIRITKFNYDSRQ

SEQ ID NO: 311 - protein, 63 aa, Mycobacterium leprae
  hypothetical: YES
GGESKGYFLLGIWMLLLWSVEFRGVDSDSPAHFLPISGLGQQAWSWLTREPGAIYVFDIAMLG

SEQ ID NO: 312 - protein, 65 aa, Mycobacterium leprae
  hypothetical: YES
ILLSCNTSVVVSKSVTASAAHARVDAAVRQRIRLVESGTTSGWVFYTVSFAIRFWIMFDGKVFVR

SEQ ID NO: 313 - protein, 62 aa, Mycobacterium leprae
  hypothetical: YES
SRLRNFNCTVVYLCTVDNVYAYRVIAVLVVTTVYVVAATSFSGLPRAGLVPALDPIGLLAGL

SEQ ID NO: 314 - protein, 188 aa, Mycobacterium leprae
  hypothetical: YES
RQSAVSHEYWSTAVSCNPGIHHIVRLDVAHTPRTTQTYRHSMLAEDIAEDFPAISINSSALDAARMLAEHGLPGLLVTDMSDKPYAVLPASQVVRFIVPRYIQDDPSLAGVLNESTADQAAEKLSSKKVRDVLPDHLVNVSPVNADDTIIEVAATMSRQRSPLLAVVKGGQLLGVITASRLLRAALKH

SEQ ID NO: 315 - protein, 64 aa, Mycobacterium leprae
  hypothetical: YES
LGPGDDPDRQIHFRIKTIDVRIHYFPLDPRNVGFPSVRNYRYGLSQKTVLLLGCWNTGTSANSR

SEQ ID NO: 316 - protein, 154 aa, Mycobacterium leprae
  hypothetical: YES
SYSQLITTDNGMTVLANLVGVSVAVFFYGHLIIDRHSRGRCVRYSNHFNHWGWIALRRTVLIVGLDYQGVVSPTGHPNFDAQYVPVVDVLRVTRCGAEHHFICRLYATESLVPQVKKFFPSCRTFSLRRVRTHQQRLQAGFLMSCLILRVDQRT

SEQ ID NO: 317 - protein, 166 aa, Mycobacterium leprae
  hypothetical: YES
CRLSEVDYKTLVGDLPPRLALAPACGMRMVNLFAIPMPGAHHRSRRIRTEVPNLIFLPIKWAYSPELILFVLTMQTAACSGYLAASQAFNVAALHAVSDLQWTCEILSHLLCCGCEDRCGGGNATVRRSHMSVSQPTTSPPRPEWSPRVLAATLALGRHANIPRLH

SEQ ID NO: 318 - protein, 474 aa, Mycobacterium leprae
  hypothetical: YES
SYGPRGRQPPPRSASTSKHSARCWNTPQDCRRPELSTWARAHAPDMREPADDQPGGTEPDPTPLHYPAGGIPNLSVTPSEIAAAAERLDQGYGPFAVDTERASGFRYSNRAYLIQIRRANAGTVLIDPVSHGNDPLTALRPVAEVISKDEWILHSADQDLPCLAEVGMRPPALYDTELAGRLAGFDRVNLATMVQRLLGFELAKGHGAADWSKRPLPSDWLNYAALDVELLIELRTAISKVLAEQDKTDWATQEFNYLRTYATRGATTETIPPTRRDRWRRTSGIRRVRDRRALAAVRELWATRDHIAQRRDIAPRRILPDTAIIDAAIADPKTIDELIAMPVFGGANQRRSAAMWLAALETARQSQDLPDEAEPSNVPPPPGRWARRKPDAAARLEAARAALATVSQRVGVPTENLVSPELVRRLCWDWEVLPESSVDPVNAVEEYLRVGQARAWQRELVVTILASAVKSSAG

SEQ ID NO: 319 - protein, 198 aa, Mycobacterium leprae
  hypothetical: YES
GGVAPVTAAEPTPFREAVAAMNAFTVRPEIELGPIRPPQRLAPYSYALGAQVKHPELDIVPEQSEDNAFGRLILLYDPDGSDAWDGTIRLVAYIQSDLDSREAIDPLLPEVAWSWLIEALESRIDHVTALGGTVTATTSVRYGDISGPPRAHQLELRASWTATTPEVGVHVKAFCEVLEHAAGLPPAGVIDLGSRSRS

SEQ ID NO: 320 - protein, 118 aa, Mycobacterium leprae
  hypothetical: YES
NINTTCSPVSHSSRRKPNVSAWSQPASTITEILPTTRPSRREPYAGRSKTRSAWTKYSLNYWYRIFDPAFETLLDLERIRFSGSNVAEGLVVHRRKLLTLFVANTKYPWRHFGSARRG

SEQ ID NO: 321 - protein, 101 aa, Mycobacterium leprae
  hypothetical: YES
SITTPPCGIVLVRSEGTAFSSGSSLDLTAETIDDYEGQVRILREDRDLVLNLANFVQPVVSADSRPSRGCRSGDCAACQHLRWQTKPRKSSMGTPNSGGGP

SEQ ID NO: 322 - protein, 319 aa, Mycobacterium leprae
  hypothetical: YES
AAGLGGVRPGRGIRCDRRPRRCMRAAVDRRNAAVWPRSRRSGRRGARRLAADAGRGWQPYGRYWCACVYQRCRARDRGPPSGSGTISFMAKLDYNTLNSTIRYLMFSVFSVRPGVLGAQRDTVIHDVRTFFKHQEKRGVVVRGLYDIAGLRADADFMIWTHAERVEALQATYADFRRTTKLGRACSPVWSSVALHRPAEFNKSHIPAFLAGEEPGAYICVYPFVRSYDWYLLPDQERRHMLAEHGMAACGYKDVRANTVPAFALGDYEWLLAFEAPGLDRIVDLMRELRATEARRHTRAETPFFTGPRVPVEQLVNSLP

SEQ ID NO: 323 - protein, 85 aa, Mycobacterium leprae
  hypothetical: YES
PCNRLECEHARCQQLCMPWSLSEDDFRQVLSVNGWEITYLGTMIGQVDLGVETFGMMATRNPDMAERVRFVLDRFRVMETMADRR

SEQ ID NO: 324 - protein, 155 aa, Mycobacterium leprae
  hypothetical: YES
VCDHSGAGESYPMSAQLVRAPGVIAVDGTRRVIVYLHRGAFLADGAKSDGKLVQTLSNFADSAFLVVNYRLLPKHSIGMALEDCYDIYRWLWLRGYNPGRLCLAGDSTGGYLALVCVQRLQEEGEEPAALVVISPFLQLAKECKQAHPNKYVLHA

SEQ ID NO: 325 - protein, 175 aa, Mycobacterium leprae
  hypothetical: YES
DYEHMRIAQHISDLIGGTPLVRLNSVVPAGTGVVAAKVEYFNSGGSSKDRIAAKMIDAAEASGQLKPGGTIVEPTSGNTGVGLALVAQHRGYKCVFVCPDKVSEDKRECAVGLRSRGSRMSDGRAARRSGQLLQRFRPVGRQDRRCLETRPVRQPSRTGQPLRDHWPGDLGRHRR

SEQ ID NO: 326 - protein, 72 aa, Mycobacterium leprae
  hypothetical: YES
RRCCLTYNRDRQRRERPTRITGGERADLGKNLACGFYVYSAIIAGNAKIKIFQEEFFGAMIAMSPFTDGDFI

SEQ ID NO: 327 - protein, 88 aa, Mycobacterium leprae
  hypothetical: YES
CSTIYRQTKNLFSVLIRTRRWYFSDGCAPNHPAGGVVSLQDQHGIVLFHQSGGCFGRSSPMGYPRADFVIGNRDVLLNVLDVGQGIPV

SEQ ID NO: 328 - protein, 62 aa, Mycobacterium leprae
  hypothetical: YES
LVLNVVLCCGCGFSLETAKSVRFLSRGRACTGAKKAPLQAHTDHHWQRLRGRRTGHLSAVRW

SEQ ID NO: 329 - protein, 221 aa, Mycobacterium leprae
  hypothetical: YES
HESIHGSCWDRVLTAALVAMSETEQQLHGVTRIRPLGSGESNTYADKRSREHKEHDEMTDTQVTWLTQESHDRLKAELDQLIANRPVIAAEINDRREEGDLRENGGYHAAREEQGQQEARIRQLQDLLNIAKVGEAPKQSGVALPGSVVKVYYNDDKSDTETFLIATRQEGVNEGKLEVYSPNSPLGGALIDAKVGETRSYTVPNGNTVQVTLISAEPYHS

SEQ ID NO: 330 - protein, 116 aa, Mycobacterium leprae
  hypothetical: YES
LAQHIAARVPTYFAAAMTRTQSGVNFDSLHYAATGPVATITLDSSEHLNTILTSHLFSTRSRRSAGWLSETTVSKSIVLRGASQSFSDGYNFGGGFQQRGRWPDDLQAMVSRQRVR

SEQ ID NO: 331 - protein, 302 aa, Mycobacterium leprae
  hypothetical: YES
AQESTGERTRGPVSELRLMAVHAHPDDESSKGAATLARYADEGHRVLVVTLTGGERGEILNPAMDLPDVHGHIAEIRRDEMAKAAEILGVEHTWLGFIDSGLPKGDPPPPLPDDCFALVPLEVCTEALVRVVRKFRPHVLTTYDENGGYPHPDHIRCHQVSVDAYEAACDYRRFPDAGKPWTVSKLYYNHGFLRARMQLLHDEFAKHGQAGPFDKWLAQSNPAHDPFESRVTTRVECSAYFSQRDDALRAHATQIDPKAEFFAAPISWQQRLWPTEEFELARSRVPTRLPEHDLFAGIEAAG

SEQ ID NO: 332 - protein, 390 aa, Mycobacterium leprae
  hypothetical: YES
SSMSEDYRGHHGITGLATKAIHAGYRPDPATGAVNVPIYASSTFAQDGVGELRGGFEYARTGNPMRAALEASLATVEEGVFARAFSSGMAASDCALRVMLRPGDHVIIPDDVYGGTFRLIDKVFTQWNVDYTPVPLSDLDAVRAAITSRTRLIWVETPTNPLLSIADITSIGELGKKHSVKVLVDNTFASPALQQPLMLGADVVLHSTTKYIGGHSDVVGGALVTNDEELDQAFGFLQNGAGAVPSPFDAYLTMRGLKTLVLRMQRHNENAITVAEFLAGHPSVSAVLYPGLPSHPGHEVAARQMRGFGGMVSLRMRAGRLAAQDLCARTKVFTLAESLGGVESLIEQPSAMTHASTTGSQLEVPDDLVRLSVGIEDVGDLLCDLKQALN

SEQ ID NO: 333 - protein, 262 aa, Mycobacterium leprae
  hypothetical: YES
CGLVQLLRSGRLPMTDQPPPSGSNPTPAPPPPGSSGGYEPSFAPSELGSAYPPPTAPPVGGSYPPPPPPGGSYPPPPPPGGSYPPPPPSTGAYAPPPPGPAIRSLPKEAYTFWVTRVLAYVIDNIPATVLLGIGMLIQTLTKQEACVTDITQYNVNQYCATQPTGIGMLAFWFAWLMATAYLVWNYGYRQGATGSSIGKTVMKFKVISEATGQPIGFGMSVVRQLAHFVDAVICCIGFLFPLWDSKRQTLADKIMTTVCLPI

SEQ ID NO: 334 - protein, 110 aa, Mycobacterium leprae
  hypothetical: YES
LGLTVHRLHARSAIAMVVVGTCWDLGAISAIPQLLRWLESTRGLRMSEQPAVCRVTGGASVGAPIIEATPEKMRSVDGYTPLGDDICAEIDQLVRVLHEKSAPSPVNTRS

SEQ ID NO: 335 - protein, 97 aa, Mycobacterium leprae
  hypothetical: YES
RMLVAGTFGVLALMLGNFVLAMFGLGGGTGLGLRSGGPVAILFSLACIGIAAFGFLLDFDAADQMIRAGAPGEGGVGYCSGLDRNVGLAICRDPASA

SEQ ID NO: 336 - protein, 105 aa, Mycobacterium leprae
  hypothetical: YES
SPVDSYSYSQPARRPTTTRQVAIMQIISPLAPLSVATHSRIQGITLWLSRFLVVACHHLFVEFLYQAMTYSCALLTQLPTRTSRWRDLAATQRRKINRLLNMAGV

SEQ ID NO: 337 - protein, 61 aa, Mycobacterium leprae
  hypothetical: YES
CWPFATHFGFTKYIFFSDVLPPFTEAIVGITERHNWVRAVDMTLLRTHHAEILRLWQGRFM

SEQ ID NO: 338 - protein, 120 aa, Mycobacterium leprae
  hypothetical: YES
RLAVVHSITFAIGRRSGHYNIIDVAWNLGFVAVAAASAVADLGSAAELVHLPQEGWQERGDTLRQPVARRRGGSRGIKNLSLTWLLDAICFITATVIGNSQLRIFNPTRPIAGFIMDRDL

SEQ ID NO: 339 - protein, 109 aa, Mycobacterium leprae
  hypothetical: YES
AQPRRSFMYLSVSWSPLKYIRKWAITNDETILANDTQPLIVLESQNPPHADVTKVVGVERPGSQVAVHNEPGNWPSRIKYPQLRIPDNCSSNETNSIKKPCKRKILYTT

SEQ ID NO: 340 - protein, 69 aa, Mycobacterium leprae
  hypothetical: YES
KTVSVAPKYQKLTAYFMHRQPRVLVARYLVIKTRVYRPVIRSLRGSGYSEETTQDVYLQGVVSGVRIVL

SEQ ID NO: 341 - protein, 139 aa, Mycobacterium leprae
  hypothetical: YES
RWPSTSCRYAGPRLAPASWPTSLGMIIRSCTWRRHSTGFPTRGPTPITNSTGDYYIATRTRGCRRKPDVSLLHRVLDDGNVMLLAATSNLEDNSRDIVGKLLHRDGGTCYGMICDTSYPTALPGVIGHVTGRVDGSRCL

SEQ ID NO: 342 - protein, 117 aa, Mycobacterium leprae
  hypothetical: YES
DRTKMAFMTSNPSGPPSQPAPAVGLTPGERAVPVTRAGALWSALFAGFLILILLLIFIAQNTTSTPFTFFGWHWSLPLGVAIMLSAVGGGLLAVAVGTARILQLRRTVKKRYVAAHR

SEQ ID NO: 343 - protein, 159 aa, Mycobacterium leprae
  hypothetical: YES
ILDRPHHSGRRQPNTSSSCCGLGALDSRRTRSNYTASMCVYHYPELDLIVNAPTVWTSPLLPTSDKLADRYLLVTGLPLAHWKCYMALGYFKLAIMAAGIDLQTYVRTGTGKDETFNDRKLEVVATLISLELATLHHAEHVVNGFSTHLITDEPPRSAF

SEQ ID NO: 344 - protein, 80 aa, Mycobacterium leprae
  hypothetical: YES
GWSWRFCNSPAQLLPRTIGLQLFVNPFVLYPSYRGIAQLALAEHVVQIRWPEVSARILADKPGHDHPILYVAQAQYWISH

SEQ ID NO: 345 - protein, 85 aa, Mycobacterium leprae
  hypothetical: YES
PQYDRHRCTARPWLASALLIGSTVELLTGVACTVLVHQRIRPDVVIALGFGIPSVTGTGRLILFSGCRWVAILGSFSSSRWRQVV

SEQ ID NO: 346 - protein, 175 aa, Mycobacterium leprae
  hypothetical: YES
VPGDDSGRVLGVFQPARRRFAGACYPDRPQSRIFRSANILAAAAMADRGIRIGPLASPHSVAGARFVRWNRGGRVSHIFLTLIADGELQYHGPDFGKASPMGLLVIVLLLVATLLLLWSMNRQLKKIPASFDSEHPELDQAADEGTELGGYLDEEPSDTDRNGPSLPPEPGADSG

SEQ ID NO: 347 - protein, 141 aa, Mycobacterium leprae
  hypothetical: YES
IDSLKRSPHHSTLNTPSWTRPPTKAPNWGAILMKSPPTPIATDLRYHRNPALTPADSPRANILGLMTSPYLCRHTGNPVHWQQWTSRVLAGMAARDVPILLSAGYAIIDHWCHITDALLPTVFLRHLLSQSRFLANSFGYF

SEQ ID NO: 348 - protein, 84 aa, Mycobacterium leprae
  hypothetical: YES
SITGVTSLMPYCLPFFCGTYYPKVAFLQILSVISDAWQDFRAGVEEASEHIPTSTDELRSMAGALSALLEPHGGGSAVTSTLCD

SEQ ID NO: 349 - protein, 82 aa, Mycobacterium leprae
  hypothetical: YES
RRHCAINAVATVLHDQDTARGGFHGAPKFSPSAMVEEVARAGSAMARCGVYDQLDGGFVRCGVDDAWGLGDTASREDVVITT

SEQ ID NO: 350 - protein, 144 aa, Mycobacterium leprae
  hypothetical: YES
YCISGRCCYYDVNVLLLCPYAPWVHSTGVRLTRRVAAPTARLLLDELADAGMFTSLLDTAADGREGSTHVWTPAHLTEVLDDEDGRWTWDVFTVTGSLRTWGGGAVSAWGSGFATTVTDRTALLAARLTRAQPGRDDKIVVSWR

SEQ ID NO: 351 - protein, 82 aa, Mycobacterium leprae
  hypothetical: YES
CDRSLTVRLGWVGVGIVREITSKGGARVFAGCFGGCTDSTPTMLAKTLNRVTELVLLSYAVSSGPVALKAGKVSVVGSCVRR

SEQ ID NO: 352 - protein, 103 aa, Mycobacterium leprae
  hypothetical: YES
RLVAAGDNRLIGNDTPEIAVGAIGGVATGYVLWLVVMSIGYNITTVSQWSLIVLILSMVSVFCSGMCGWWLRQRRKHAWGAFTFGLPVFPVVLTLAVLAKIYL

SEQ ID NO: 353 - protein, 474 aa, Mycobacterium leprae
  hypothetical: YES
PATSVAVVTHYDVVVLGAGPGGYVAAIRAAQLGLSTAVVEPKYWGGICLNVGCIPSKVLLHNAELAHIFTKEAKTFGISGDASFDYGIAYDRSRKVSEGRVAGVHFLMKKNKITEIHGYGRFTDANTLSVELSEGVPETPLKVTFNNVIIATGSKTRLVPGTLLSTNVITYEEQILTRELPDSIVIVGAGAIGIEFGYVLKNYGVDVTIVEFLPRAMPNEDAEVSKEIEKQFKKMGIKILTGTKVESISDNGSHVLVAVSKDGQFQELKADKVLQAIGFAPNVDGYGLDKVGVALTADKAVDIDDYMQTNVSHIYAIGDVTGKLQLAHVAEAQGVVAAEAIAGAETLALSDYRMMPRATFCQPNVASFGLTEQQARDGGYDVVVAKFPFTANAKAHGMGDPSGFVKLVADAKYGELLGGHMIGHNVSELLPELTLAQKWDLTATELVRNVHTHPTLSEALQECFHGLIGHMINF

SEQ ID NO: 354 - protein, 121 aa, Mycobacterium leprae
  hypothetical: YES
RDENLAAELAAVPVAVAGRYQLSEVVEVGYGDPRCINRRRGDRAHPDFIVWYHSIDTTAPLFMVYGASLCRRTHPGRRDASPWKVSLSRRLALAVLSGPFLPSSPRRPLIYEIYELTTKHI

SEQ ID NO: 355 - protein, 147 aa, Mycobacterium leprae
  hypothetical: YES
TNTYASAGVPGSLELDGQSPNNLLLRHDGRQRQLPRQGAEGFTVLAINQSVHRAIAQPDSRPISMTSFETGGDPNQSSPGQFVGHRGDAGFSGFQRSAREGVVLHTIEIDKDESVPPGSPVVSGPIWARTWPAGFMYTRRSLPATPR

SEQ ID NO: 356 - protein, 90 aa, Mycobacterium leprae
  hypothetical: YES
IDEDTVTYHLRDPLSMVGKIIPWNFTIPMGAWKLAPGNAVVLKPAEQTPMPVQVSRAAWNSTARAPITFFSDMTVVNDNFQDKAPKDSPC

SEQ ID NO: 357 - protein, 98 aa, Mycobacterium leprae
  hypothetical: YES
NYRRAKSDVIWDDLQDNVLVGNGFGADSLTEFGYTRPIKRWCLNTPLADAKTSFEDGKLRCPDLCVRRSNARLRMHLHGASASFMELEALRTSRLGAA

SEQ ID NO: 358 - protein, 82 aa, Mycobacterium leprae
  hypothetical: YES
KLYELRGSELLSIDKPTDASASIYRNWLLIALRTDWIFGTNTYPTVLLLSANYDEFLDDTAKLRVVFELYEHTSLNILYVDP

SEQ ID NO: 359 - protein, 147 aa, Mycobacterium leprae
  hypothetical: YES
SLIRGDGEYRPGWNTRETLDGLHKVAEDFVSVAKDLVNCGMTGVEQFGSRGGSNGRLLMGVMRTKYPEKFGILVCDMSAGHALLPSTVERRFLDGLPWQAGQPPRLGVHRLIFVLLEHFGDLAVSAGAVHRGGRVHTGHSRKMTATL

SEQ ID NO: 360 - protein, 88 aa, Mycobacterium leprae
  hypothetical: YES
LTIRLSAHNCDNEDAYQLGSNLGDTSLEAFERHLFVYQLDFSFLDTGQRPASKRVPLDIGKAEQAYLCFQLDKLYIRLYGCRSSRCCR

SEQ ID NO: 361 - protein, 132 aa, Mycobacterium leprae
  hypothetical: YES
TNRCRSNASKLVSPRLLPSWYASSLSQLWALSLIVNQAACEIHEPSVYPDARWHSGWPDAQHPDALDLIRATETQGVRIVIARRDGPFDNYSQAVPKLRPDPSTCLLFLLARKPRLVTCCRSTTSKPRKGYG

SEQ ID NO: 362 - protein, 126 aa, Mycobacterium leprae
  hypothetical: YES
PHGVANDVAQLVQRRPARQTICTPVASQFADLPQHDEPEAAHTAEAQDVDDVSAQVQIRIAAFIYGVPVHDMGSRIGAARFRLARELMPIEGSKRVRDLVTRYLAHVTSIVSPAPSCIGAEPVVIP

SEQ ID NO: 363 - protein, 976 aa, Mycobacterium leprae
  hypothetical: YES
ASFQRSQRLHLLPGEVRVTVKCANDLDTHTKPPFVARMIHRFAVPIILVWLAIAVTVSVFIPSLEDVGQERSVSLSPKDAPSYIAMQKMGQVFNEGNSDSVIMIVLEGDKPLGDDAHRFYDGLIRKLRADKHVQSVQDFWGDPLTAPGAQSNDGKAAYVQLSLAGNQGELLAQESIDAVRKIVVQTPAPPGITAWVTGASALIADMHHSGDKSMIRITATSVIVILVTLLLVYRSFITVILLLFTVGIESAVARGVVALLGHTGLIGLSTFAVNLLTSLAIAAGTDYGIFITGRYQEARQANENKEAAFYTMYRGTFHVILGSGLTISGATFCLSFARMPYFQTLGVPCAVGMLIAVAVALTLGPAVLTVGSRFGLFEPKRLIKVRGWRRIGTVVVRWPLPILITTCAIAMVGLLALPGYRTNYKDRAYLPASIPANQGFAAADRHFPQARMKPEILMIESDHDMRNPADFLILDKLARGIFRVPGISRVQAITRPDGTAMDHTSIPFQISMQNAGQVQTMKYQKDRMNDLLRQAENMAETIASMRRMHQLMALLTENTHHILNDTVEMQKTTSKLRDEIANFDDFWRPIRSYFYWERHCFNIPICWSFRSIFDALDGVDQIDERLNSIVGDIKNMDLLMPQMLEQFPPMIESMESMRTIMLTMHSTMSGIFDQMNELSDNANTMGKAFDTAKNDDSFYLPPEVFKNTDFKRAMKSFLSSDGHAARFIILHRGDPASVAGIASINAIRTAAEEALKGTPLEDTKIYLAGTAAVFKDIDEGANWDLVIAGISSLCLIFIIMLIITRAFVAAAVIVGTVALSLGASFGLSVLLWQHILGIELHYLVLAMSVIVLLAVGSDYNLLLVSRFKQEIQAGLKTGIIRSMGGTGKVVTNAGLVFAFTMASMVVSDLRVIGQVGTTIGLGLLFDTLIVRSFMMPSIAALLGRWFWWPQQGRTRPLLTVAAPVGLPPDRSLVYSD

SEQ ID NO: 364 - protein, 177 aa, Mycobacterium leprae
  hypothetical: YES
ACGPGSPAPRSEVELGRADIGPSMSKRQRGKGISIFKLLSRIWIPLVILVVLVVGGFVVYRVHSYFASEKRESYADSNLGSSKPFNPKQIVYEVFGPPGTVADISYFDANSDPQRIDGAQLPWSLLMTTTLAAVMGNLVAQGNTDSIGCRIIVDGVVKAERVSNEVNAYTYCLVKSA

SEQ ID NO: 365 - protein, 61 aa, Mycobacterium leprae
  hypothetical: YES
WSVRTEGVWAGVQSSLAKVNHGALLLPSCRALGKSNAYIMRNGALLCRWQIMPVRYANHIL

SEQ ID NO: 366 - protein, 70 aa, Mycobacterium leprae
  hypothetical: YES
IIPMVVAQLTFQRSRTEGNKRQRPAAVVETACPLALETGVTSVTLTADAGHAGIHYSAVRRYFTSYKHKL

SEQ ID NO: 367 - protein, 60 aa, Mycobacterium leprae
  hypothetical: YES
VAKIPVAVAEREVRIVIVVAVMEFGVYLLRSFFFYFHDNKAVTNGFPLTSQPFNTKHLVH

SEQ ID NO: 368 - protein, 149 aa, Mycobacterium leprae
  hypothetical: YES
KQTQHVTKLLEDPLTVAGSQSSDNQAVYVQMYLASNQGKNLANESVQQIVNGTPALSDIKAYMIGGAVPAGADQSTAGEHRVQQVTMITFLVDIVMLLFVYCSVVQVNLTLVMVVIELMVARQGIIFQLIITPLDYHNLSGKSACTAGH

SEQ ID NO: 369 - protein, 411 aa, Mycobacterium leprae
  hypothetical: YES
KHHEKIESTDTARNFSQARIKPKLLMIETDHNIPCFNIPICWSFRSIFDALDGVDQIDERLNSIVGDIKNMDLLMPQMLEQFPPMIESMESMRTIMLTMHSTMSGIFDQMNELSDNANTMGKAFDTAKNDDSFYLPPEVFKNTDFKRAMKSFLSSDGHAARFIILHRGDPASVAGIASINAIRTAAEEALKGTPLEDTKIYLAGTAAVFKDIDEGANWDLVIAGISSLCLIFIIMLIITRAFVAAAVIVGTVALSLGASFGLSVLLWQHILGIELHYLVLAMSVIVLLAVGSDYNLLLVSRFKQEIQAGLKTGIIRSMGGTGKVVTNAGLVFAFTMASMVVSDLRVIGQVGTTIGLGLLFDTLIVRSFMMPSIAALLGRWFWWPQQGRTRPLLTVAAPVGLPPDRSLVYSD

SEQ ID NO: 370 - protein, 95 aa, Mycobacterium leprae
  hypothetical: YES
STNCLLLLIRIFHCQTQHSRSTPPRTPGSRPKPTWVLGKSGDYPGYGKYQVGSATFGYLDELTYYAFALRSTWNLEDQDAIADNDDDAIRLNYIA

SEQ ID NO: 371 - protein, 78 aa, Mycobacterium leprae
  hypothetical: YES
SVSNGRTAVIAQCLAELVTLDTPTVSVLLGQGSGGPTLAMVPADRVLAPLPPEGASAIVFHDTAHAAEFAAAQGFRSS

SEQ ID NO: 372 - protein, 115 aa, Mycobacterium leprae
  hypothetical: YES
KITLYLSVSSPVSSGCMAIRWTFLTYLRDKPNWLTRWRSRTMFGRVRSEQKRVAVRALPSPGHTIVMANEGFNDVLTLKDADIGVKMGAGSSVSCTVAQMVLLDNIFAKLLYVVC

SEQ ID NO: 373 - protein, 103 aa, Mycobacterium leprae
  hypothetical: YES
LLVPACLLTIYTQLFTALAGWWLSVLRMVGALVPMVLAELVLITSIAFAVCCIRLDQRQCLVQELPAIEGLARVDVICVYKNDTLTETGMRVCFVEDLTVQRS

SEQ ID NO: 374 - protein, 94 aa, Mycobacterium leprae
  hypothetical: YES
STAPMTSRTLVVGSPIWDGYLRNRGFANHVPGRVALFRDVPQRSDGRLLCLVSGSGACANAPGRMYSDMLEPVPVILLSRLAVDRKQITGRGPG

SEQ ID NO: 375 - protein, 86 aa, Mycobacterium leprae
  hypothetical: YES
CQAGTIVQATGVDLYACLRCSIEKVLPRPERLAALLNSKQDAVIRCAAEVEGIDFTNFTITLVLAHARDVVIGRPPTLRAPRRRVD

SEQ ID NO: 376 - protein, 77 aa, Mycobacterium leprae
  hypothetical: YES
PGDWYSHRRRKRSGKIGRMDTGVSSPRVLVVDDDSDVLASLERGLRLSGFEVSTAIDGAEALRNATETRPDAIVLDI

SEQ ID NO: 377 - protein, 347 aa, Mycobacterium leprae
  hypothetical: YES
PTAADRSIYRSRICTVLPDVRRQRGRSRNLRRKGERISCGELSMNLDTLDRPVKAVVLRPISVRRRIKNNVATMFFFTSFLIALVPLVWLLSVVVARGFYAVTRFDWWTHSLRGVMPEEFAGGVYHALYGSLVQAVVAAIMAVPLGSMTAVYLVEYGSGPFVRVTTFMVDVLAGVPSIVAALFIFCLWIATLGFQQSAFAVSLALVLLMLPVVVRSTEEILRLVPDELREACYALGIPKWKTIVRIVFPIATPGIISGVLLSIARVIGETAPVLVLVGYSRSINFDIFDGNMASLPLLIYTELTNPEYAGFLRVWGAALTLIILVAGINLFGAAFRFLATRRCSGCR

SEQ ID NO: 378 - protein, 333 aa, Mycobacterium leprae
  hypothetical: YES
YDIVTATNSLVPATVIKPTPAAVGSYVTRRCDRLFKSAAAAAGSTVVAAILLIAIFLLLRAVPSLRANHANFFTSAKFDTTGDKNLAFGIRDLFMVTVLSSICALVLAVPVAIGIAVFLTQYVPARLSRLFSAMVDLLAAVPSIIFGLWGVFVLAPKLQPIAVFLNHNLGWLFLFKQGNVSLAGGGTIFTSGIVLAVMILPIVTSVSREVFRHTPLIQIEAAQALGATKWEVVQMTVLPFGRSGVAAAAMLGLGRALGETLAVLIILRSAARSGNWSLFDGGYTFASKIASAASEFSQPLPTGAYIAAGFALFFLTFVVNAVARAISGGRVNG

SEQ ID NO: 379 - protein, 372 aa, Mycobacterium leprae
  hypothetical: YES
GARLKLNQFGAAIGLLATGALLSGCGSDNNAAVGSARTGPSSGQVSCGGKPTLKASGSTAQANAMTRFVNAFERSCPGQTLNYTANGSGAGVSEFNGNQTDFGGSDSPLSRKEYAAAEQRCGSQAWNLPVVFGPIAITYNVNGLSSLNLDGPTTAKIFNGSIASWNDPAIQALNTGVALPAEPIHVVFRNDESGTTDNFQRYLDVASNGEWGKGIGKTFKGGVGEGAKGNDGTSAAVKSTEGSITYNEWSFASARKLNTAKIATSADPEPIAISVDSVGKTISGATIIGEGNDLVLDTVSFYKPAQPGSYPIVLATYEIVCSKYPDAQVGRAVKAFLQSTIGGGQNGLGDNGYVPIPDSFKSRLSTAANAIA

SEQ ID NO: 380 - protein, 428 aa, Mycobacterium leprae
  hypothetical: YES
QELFVNLTCLSEGNGSRGKALAESTQAELKTSWYLLGPAFVAAIAYVDPGNVAANVSSGAQFGYLQLWVVVVANVLAGLVQYLSAKLGLVTGQSLPQAISKQMSHPFRLGFWLQAELVAMATDVAEIVGGAIAFHILFRVSLLLGGVITGTVSLLLLMVKDRRGQLLFERVITGLLFVIVVGFTSSFFVATPSPEDMVNGLLPRFQGTESVLLAAAIIGATVMPHAVYLHSGLALDRHGHPHAGRSRRRLLRVTRLDVILAMTIAGIVNTAMLLVAAINLQHHQVTAYIEGTYTAIQDTLGATIAMLFAIGLLASSLASASVGAYAGALIMQGLLQRSIPMLIRRLITLCPAIAILALGFDPTRALVLSQIVLSFGIPFAVLPLVKLTNNRGLMGNDTNHPATTVLGWAVAILVSLLNVVLIYLTVTS

SEQ ID NO: 381 - protein, 171 aa, Mycobacterium leprae
  hypothetical: YES
ACLCCRSSYTRRTPTARLAGHSTRVATMIHRLRLGWLVAFFATIVLISVWIPWLTTKVNDEGWANAIGGTHGNLELPSGFGAGQLIVLLSSTLLVAGAMMGRGLSVKVASIAALIISLLIVVIVVWYYQLNVNPPVVAECGLYLGAAGAVCAMVCSVWAVIAAVAAGRSSL

SEQ ID NO: 382 - protein, 69 aa, Mycobacterium leprae
  hypothetical: YES
REGGPEVLSLLVIAGARPNASYVIVDHPNEPGRVAPVALVVLEQGATRFLRDYEIFSCPVCFGVGNFRR

SEQ ID NO: 383 - protein, 126 aa, Mycobacterium leprae
  hypothetical: YES
CGLRSRRDYDIGVGFGESYHDGCIEVAVVTGYDGDFVVATETAKDHCGPSHATVSRQGMSTDRAENLTVSVSGIGTSLSYGRANAMLRLDDRPPQRKVYRNYVRVECVGPGSSAVYQQRPVKMFRR

SEQ ID NO: 384 - protein, 82 aa, Mycobacterium leprae
  hypothetical: YES
FPRLRILLQEVVAVEHYGVDVADRDELQDLDLAAALLGQCGDVVIGDHHQLAFVEFVGLGEITVFDDLSTLHRILVCIGSSH

SEQ ID NO: 385 - protein, 77 aa, Mycobacterium leprae
  hypothetical: YES
RLVGGETLWRGTLSCYRLRRQAEAGWLWSVRPGVIAGLAAAALHDSDFIDNDEPVELIWRNQNLPADMITRNQRIDE

SEQ ID NO: 386 - protein, 82 aa, Mycobacterium leprae
  hypothetical: YES
LNSAAETVFDSYSQLSALSNQALDEVRVAPGVHQEVGFDEQPVGIEQQGGRNPVHELDQIGGFAGARDSGLSCSVIMVACWS

SEQ ID NO: 387 - protein, 105 aa, Mycobacterium leprae
  hypothetical: YES
TLPSTTSDGTMPNISTKNLKNACTFNVGTTHALTVAAVPLMFEHPDCCSVINISSTMVRLDGHVVSAAYGTTKATSSQYTRLSRHWTYSGSTPSHLGPSAPPHWI

SEQ ID NO: 388 - protein, 71 aa, Mycobacterium leprae
  hypothetical: YES
KTLRAHNKVIRACTSHGIDPGFANDLLPLALPGTYQNQSIQQQVRCMKTIDYGGLRHLRQHHRHVRRDGVW

SEQ ID NO: 389 - protein, 60 aa, Mycobacterium leprae
  hypothetical: YES
VASFATGAKDGDQSVTSVWWAERFSALLRDLEFLPNSPMLMNAGTNIGLLSVCLALPVEN

SEQ ID NO: 390 - protein, 78 aa, Mycobacterium leprae
  hypothetical: YES
LVGDQGHHNRSTRPPGTDYRRFTSQMGITVCLVCLATDHEGIVVPSVDAVVVTVAEQKDTDERAQHRFRCCAASPLPR

SEQ ID NO: 391 - protein, 105 aa, Mycobacterium leprae
  hypothetical: YES
RSGNKLAKLRIEQANRRQSPCGHRQAANYRSGKQPVLVTLLWSSELKLTIKQGRRVPDGLGVGVRKCPFSKGLEVTIAHSHSPSMIASFGCVDDLQAMPAHNSAI

SEQ ID NO: 392 - protein, 79 aa, Mycobacterium leprae
  hypothetical: YES
FAVRAEHGPLFGDRYIVGKYILRSTSRWMTRDAKPLVTEITIVPMSVDHGMLPRLLAHLVHPSTTGVPSRYNDSSLPLS

SEQ ID NO: 393 - protein, 122 aa, Mycobacterium leprae
  hypothetical: YES
GWLIFELVRAVKSKERRELIRVELTQSLNTNRLHLGRPPADAPTHTAQIITPQNTKTNPLLNFVAPKIAVFSFSATSGDRYFPPCTLCPRRYYGTIRARSAANEVCTICALARVYGVITNRG

SEQ ID NO: 394 - protein, 135 aa, Mycobacterium leprae
  hypothetical: YES
PGEVAGFDDSVDALIVLGSSLRNLPRTSMPSSPRLLLNTSALVLPADSVAALHSAGAACGEKKAGLYGAPASPYETVSIGPGISTDLADHGQFSRHIGMLQPVASRQHPCDARIGCVSGRRRGALRSLARLYDAL

SEQ ID NO: 395 - protein, 66 aa, Mycobacterium leprae
  hypothetical: YES
PGSPAAATKDPRDDWTTSTPRLDVAIPCGLGTNGVWLLSNCAVLEDIFIDGAKFVVQQGHGVARDL

SEQ ID NO: 396 - protein, 289 aa, Mycobacterium leprae
  hypothetical: YES
SRRLPVRKLWSPPQWPYGPSEGGPVTPTLQGMTERTGSNDSGRPLAWRLASLRNSMRLFDDRVDAGRHLAERLESLRGKDMVVLGLPRGGVPVAFEVAKALRAPLDVLVVRKLGVPFQPELAFGAIGEGGVRVTNDSVVAEADLSQDEMAAIETEQRAELMRRSERFHRRHDRAPIGGRIAVIVDDGIATGATAKASCQVARAQGVSKVVLAVPIGGRDIFARFAGYADEVVCLHTPAFFCAVGQGYCNFTQTSDAEVIALLDRAREGFGESATTATLGDPQIRDEEVW

SEQ ID NO: 397 - protein, 91 aa, Mycobacterium leprae
  hypothetical: YES
FSPTAMAAAPATTISIRGLEYSRFATLLFDLLTPDEERDRANVFDVELLERRLSRYHRLARQPDTATLLVRLLRCEHRGRCCAGRRGRSPP

SEQ ID NO: 398 - protein, 74 aa, Mycobacterium leprae
  hypothetical: YES
TAAVALHDLADLIAISGGDPYRVRWYGKAARSVAGYRLDLDISERKGLMAILALGAHTSDKLLESVADGPYRHL

SEQ ID NO: 399 - protein, 61 aa, Mycobacterium leprae
  hypothetical: YES
ITTVFDGVLDFLGATQRRPDLDDFASRLELMARLTIGVRLGNLAPNYNRLLHDQNRASRIQ

SEQ ID NO: 400 - protein, 68 aa, Mycobacterium leprae
  hypothetical: YES
GGGCVVRVDSVTGTTRDHRLNRVGPEAFAISHDNNGNLDGADDSDIQAIGIARYEVCDEPVRNANNCH

SEQ ID NO: 401 - protein, 113 aa, Mycobacterium leprae
  hypothetical: YES
LPVRAATYAGCGTGYTTPHTGEPERHRRFLGARLDYFTPSEYLAINHIGLIGLGESWKGIKNSEIEIGDRLLINPRDSHPVEESGVRMLLDATSRSVIRPVTTRYRMQKGSLR

SEQ ID NO: 402 - protein, 61 aa, Mycobacterium leprae
  hypothetical: YES
RDHDMDVEIVSKFLSTLSEDDSHSRRIVPWRPQTIEWDANDLNALAGEIPSYLKAYLPTQH

SEQ ID NO: 403 - protein, 60 aa, Mycobacterium leprae
  hypothetical: YES
KPLHPEFTVYHPFDEDGMLHMVGFRDGKAFFRNSFIRTDGFLSENIAGEPLWPGWAEPVQ

SEQ ID NO: 404 - protein, 98 aa, Mycobacterium leprae
  hypothetical: YES
LSGLVRVDRSTLIVRDIHHEQVIMPSRNSVLLGAPLLVDLMSSDVERAHDSTARYLAVSLSLTDRSKVDTSIVPKDGHRVAVLMANRSEMQSPDNWAT

SEQ ID NO: 405 - protein, 184 aa, Mycobacterium leprae
  hypothetical: YES
HFWVTSRIKRMAKLTGSIDVPLPPNEAWMCASDLARFGEWLTIHRAWRSKLPEVVEKGTVIESYVEVKGMPNRIRWTVVRYKAPEAMTLNGDGVGGVKVKLIAKVSPKDDGSVVSFDVHLGGSALFGPIGMIVAVALRTDIRESLQNFVTAFSRPEPGLIRSRALVVDQHSRAVVEQRSASAGL

SEQ ID NO: 406 - protein, 75 aa, Mycobacterium leprae
  hypothetical: YES
SNTRILLSGAAELIPKGIGDAVMSGSFVVPGTGSYCATMVGLQAYAVQLAGEDRKCTLVKFELHKAISRFLQFIT

SEQ ID NO: 407 - protein, 117 aa, Mycobacterium leprae
  hypothetical: YES
GDGQDNKIDAETSFNWLRFWEATNFAVLLPEEIGIIMLTNVAPYGTSETLTAEFIYLLYCNQIRQNWAVLSNHEVGSMNNPEGMMFRPTAPSQLCSGQTAERLPRRVRQWLLGSGHS

SEQ ID NO: 408 - protein, 74 aa, Mycobacterium leprae
  hypothetical: YES
PLSNPPYTLFDPSPNEVSGLQILTCRLDVALSKVDGLVSDLMKSSGIPGMAMVIVNSGKELYANLFGAKGISIG

SEQ ID NO: 409 - protein, 250 aa, Mycobacterium leprae
  hypothetical: YES
AGLMIGITQAEGVMTIELQRPERRNALNSQLIEKLREAVQKASSADSEVSTRVIVLTGQGTVFCAGADLSGDAFAADYPDRLIELHRVMDAVPMPVIGAINGPAIGAGLQLAMQCDLRVVAPDAYFQFPTSKYGLALDNWSIRRLSSLVGHGRARAMLLTAEKLTADIALQTGMANRIGALADAQAWAAEVTGLAPLAIQHAKRVLNDDGSIEEAWPEHKKLFDKAWTSQDVIEAQVARVEKRPPKFQGA

SEQ ID NO: 410 - protein, 215 aa, Mycobacterium leprae
  hypothetical: YES
AAAALVSPSSDGTRMQEGTVAFLQMVKIAAAVKLSKRAGLPYLGYLRNPTTGGVFASWGSLGHVTVAEPGVLIGFLGPRVYELLYGEPFPSDIQTAENLQRHGVIDAIVTLDGLQLTLNRALTMIADVPKLIPTPQRPEPIPDVPAWNSVMGSRRPERPSVAQVLRHGATDRVLLSGPGHGEAATTLLALARLAGQTAVVIGQQRKDGGNRPVSG

SEQ ID NO: 411 - protein, 120 aa, Mycobacterium leprae
  hypothetical: YES
DREPLALPITKSHARELTDAQAASGLDESVLTSQGCVFGRRVAIIVCKFSFLGGRIGVAAAERITAAVQRRQLSGCRAGLAKFRWHPYAGRHRRVPADGEDRCGRQTLQTGGSALLRVLA

What is claimed is:

1. A non-naturally occurring peptide of *Mycobacterium tuberculosis* comprising an amino acid sequence corresponding to the amino acid sequence of SEQ ID NO:12.

* * * * *